US008466108B2

(12) United States Patent
Dockal et al.

(10) Patent No.: US 8,466,108 B2
(45) Date of Patent: Jun. 18, 2013

(54) TFPI INHIBITORS AND METHODS OF USE

(75) Inventors: Michael Dockal, Vienna (AT); Hartmut Ehrlich, Vienna (AT); Friedrich Scheiflinger, Vienna (AT); Ulf Reimer, Berlin (DE); Ulrich Reineke, Berlin (DE); Thomas Polakowski, Berlin (DE); Eberhard Schneider, Denkte (DE)

(73) Assignees: Baxter International Inc., Deerfield, IL (US); Baxter Healthcare SA, Glattpark (Opfikon) (CH)

( * ) Notice: Subject to any disclaimer, the term of this patent is extended or adjusted under 35 U.S.C. 154(b) by 475 days.

(21) Appl. No.: 12/643,818

(22) Filed: Dec. 21, 2009

(65) Prior Publication Data

US 2010/0173847 A1 Jul. 8, 2010

Related U.S. Application Data

(60) Provisional application No. 61/139,272, filed on Dec. 19, 2008.

(51) Int. Cl.

| | |
|---|---|
| ***A61K 38/36*** | (2006.01) |
| ***A61K 38/37*** | (2006.01) |
| ***A61K 38/10*** | (2006.01) |
| ***A61K 38/00*** | (2006.01) |
| ***A61K 38/04*** | (2006.01) |
| ***A61K 38/16*** | (2006.01) |
| ***C07K 14/745*** | (2006.01) |
| ***C07K 14/755*** | (2006.01) |

(52) U.S. Cl.
USPC ....... 514/13.7; 514/14.1; 514/14.9; 514/21.4; 530/326

(58) Field of Classification Search
None
See application file for complete search history.

(56) References Cited

U.S. PATENT DOCUMENTS

| | | | |
|---|---|---|---|
| 4,179,337 | A | 12/1979 | Davis et al. |
| 4,301,144 | A | 11/1981 | Iwashita et al. |
| 4,496,689 | A | 1/1985 | Mitra |
| 4,640,835 | A | 2/1987 | Shimizu et al. |
| 4,670,417 | A | 6/1987 | Iwasaki et al. |
| 4,791,192 | A | 12/1988 | Nakagawa et al. |
| 5,356,783 | A | 10/1994 | Buonassisi et al. |
| 5,369,038 | A | 11/1994 | Koike et al. |
| 5,399,363 | A | 3/1995 | Liversidge et al. |
| 5,439,686 | A | 8/1995 | Desai et al. |
| 5,466,468 | A | 11/1995 | Schneider et al. |
| 5,498,421 | A | 3/1996 | Grinstaff et al. |
| 5,576,294 | A | 11/1996 | Norris et al. |
| 5,622,988 | A | 4/1997 | Worsaae et al. |
| 5,629,176 | A | 5/1997 | Bjorn et al. |
| 5,849,703 | A | 12/1998 | Wun et al. |
| 5,849,875 | A | 12/1998 | Wun |
| 5,902,582 | A | 5/1999 | Hung |
| 5,997,864 | A | 12/1999 | Hart et al. |
| 6,113,896 | A | 9/2000 | Lazarus et al. |
| 6,171,587 | B1 | 1/2001 | Wun et al. |
| 6,180,607 | B1 | 1/2001 | Davies et al. |
| 6,183,743 | B1 | 2/2001 | Hart et al. |
| 6,262,233 | B1 | 7/2001 | Gentz et al. |
| 6,548,262 | B2 | 4/2003 | Gentz et al. |
| 6,916,629 | B2 | 7/2005 | Gentz et al. |
| 7,015,194 | B2 | 3/2006 | Kjalke |
| 2003/0040480 | A1 | 2/2003 | Rojkjaer |
| 2003/0045498 | A1 | 3/2003 | Kovesdi et al. |
| 2003/0059474 | A1 | 3/2003 | Scott et al. |
| 2003/0064033 | A1 | 4/2003 | Brown et al. |
| 2003/0092627 | A1 | 5/2003 | Petersen et al. |
| 2003/0118574 | A1 | 6/2003 | Rojkjaer |
| 2003/0124132 | A1 | 7/2003 | Thorpe et al. |
| 2003/0129193 | A1 | 7/2003 | Thorpe et al. |
| 2003/0139374 | A1 | 7/2003 | Thorpe et al. |
| 2003/0211075 | A1 | 11/2003 | Thorpe et al. |
| 2004/0018516 | A1 | 1/2004 | Francischetti et al. |
| 2004/0043077 | A1 | 3/2004 | Brown |
| 2004/0259768 | A1 | 12/2004 | Lauermann |
| 2005/0032690 | A1 | 2/2005 | Rojkjaer et al. |
| 2005/0048127 | A1 | 3/2005 | Brown et al. |
| 2005/0142201 | A1 | 6/2005 | Rashba-Step et al. |
| 2005/0142205 | A1 | 6/2005 | Rashba-Step et al. |
| 2005/0142206 | A1 | 6/2005 | Brown et al. |
| 2005/0147689 | A1 | 7/2005 | Egilmez |
| 2005/0170005 | A1 | 8/2005 | Rashba-Step et al. |
| 2005/0181978 | A1 | 8/2005 | Rojkjaer et al. |
| 2005/0214836 | A1 | 9/2005 | Nakamura et al. |
| 2005/0233945 | A1 | 10/2005 | Brown et al. |
| 2005/0282771 | A1 | 12/2005 | Johnson |
| 2006/0024379 | A1 | 2/2006 | Brown et al. |

(Continued)

FOREIGN PATENT DOCUMENTS

| | | |
|---|---|---|
| EP | 0507039 | 10/1992 |
| EP | 0539975 | 5/1993 |

(Continued)

OTHER PUBLICATIONS

Nakabachi. Science, 2006, 314, 267.*
Mace. Journal of Molecular Biology, 1995, 251, 116-134.*
Hedner et al., Tissue factor and factor VIIa as therapeutic targets in disorders of hemostasis. *Annu. Rev. Med.* 59: 29-41 (2007).
Lean et al., The effects of tissue factor pathway inhibitor and anti-b-2-glycoprotein-I IgG on thrombin generation. *Haematologica*, 91: 1360-6 (2006).
Liu et al., Improed coagulation in bleeding disorders by non-anticoagulant sulfated polysaccharides (NASP). *Thromb. Haemost.* 95: 68-76 (2006).
Tang et al., Sepsis-induced coagulation in the baboon lung is associated with decreased tissue factor pathway inhibitor. *Am. J. Pathol.* 171(3): 1066-77 (2007).

(Continued)

*Primary Examiner* — Noble Jarrell
(74) *Attorney, Agent, or Firm* — Marshall, Gerstein & Borun LLP

(57) ABSTRACT

The invention provides peptides that bind Tissue Factor Pathway Inhibitor (TFPI), including TFPI-inhibitory peptides, and compositions thereof. The peptides may be used to inhibit a TFPI, enhance thrombin formation in a clotting factor-deficient subject, increase blood clot formation in a subject, and/or treat a blood coagulation disorder in a subject.

5 Claims, 178 Drawing Sheets

U.S. PATENT DOCUMENTS

| | | | |
|---|---|---|---|
| 2006/0040896 | A1 | 2/2006 | Kennedy |
| 2006/0198837 | A1 | 9/2006 | Morrissey et al. |
| 2006/0199766 | A1 | 9/2006 | Petersen et al. |
| 2006/0205036 | A1 | 9/2006 | Ostergaard et al. |
| 2006/0260777 | A1 | 11/2006 | Rashba-Step et al. |
| 2007/0027077 | A1 | 2/2007 | Rojkjaer |
| 2007/0092452 | A1 | 4/2007 | Rashba-Step et al. |
| 2007/0192036 | A1 | 8/2007 | Jojic et al. |
| 2007/0207210 | A1 | 9/2007 | Brown et al. |
| 2007/0280920 | A1 | 12/2007 | Petersen et al. |
| 2007/0281031 | A1 | 12/2007 | Yang |
| 2008/0026068 | A1 | 1/2008 | Brown et al. |
| 2008/0038307 | A1 | 2/2008 | Hoffmann |
| 2008/0044852 | A1 | 2/2008 | Kanayinkal et al. |
| 2008/0058266 | A1 | 3/2008 | Rojkjaer |
| 2008/0161425 | A1 | 7/2008 | Hackeng et al. |
| 2008/0187595 | A1 | 8/2008 | Jordan et al. |
| 2008/0199506 | A1 | 8/2008 | Horres et al. |
| 2009/0054837 | A1 | 2/2009 | Von Holst et al. |
| 2009/0098119 | A1 | 4/2009 | Lu et al. |
| 2009/0130086 | A1 | 5/2009 | Roejkjaer et al. |
| 2009/0232866 | A1 | 9/2009 | Pavone-Gyongyosi et al. |
| 2009/0269325 | A1 | 10/2009 | Johnson |
| 2010/0008935 | A1 | 1/2010 | Borlak et al. |
| 2010/0010946 | A1 | 1/2010 | De Winter et al. |
| 2010/0173847 | A1 | 7/2010 | Dockal et al. |

FOREIGN PATENT DOCUMENTS

| | | | |
|---|---|---|---|
| EP | 1403638 | | 3/2004 |
| EP | 1593389 | | 11/2005 |
| FR | 2934052 | A1 | 1/2010 |
| JP | 4252954 | | 9/1992 |
| JP | 6007193 | | 1/1994 |
| JP | 6153985 | | 6/1994 |
| JP | 2000128803 | | 5/2000 |
| JP | 2002097200 | | 4/2002 |
| JP | 2005306875 | | 11/2005 |
| WO | WO-92/07584 | | 5/1992 |
| WO | WO-93/14120 | | 7/1993 |
| WO | WO-93/14121 | | 7/1993 |
| WO | WO-93/14122 | | 7/1993 |
| WO | WO-93/14123 | | 7/1993 |
| WO | WO-94/02172 | | 2/1994 |
| WO | WO-95/12674 | | 5/1995 |
| WO | WO-95/18830 | | 7/1995 |
| WO | WO-96/20278 | | 7/1996 |
| WO | WO-96/28153 | | 9/1996 |
| WO | WO-97/09063 | | 3/1997 |
| WO | WO-97/23509 | | 7/1997 |
| WO | WO-97/47651 | | 12/1997 |
| WO | WO-98/33920 | | 8/1998 |
| WO | WO-99/42119 | A1 | 8/1999 |
| WO | WO-01/07070 | | 2/2001 |
| WO | WO-01/36472 | | 5/2001 |
| WO | WO-01/85198 | | 11/2001 |
| WO | WO-01/85199 | | 11/2001 |
| WO | WO-01/87323 | | 11/2001 |
| WO | WO-03/007983 | | 1/2003 |
| WO | WO-03/028840 | | 4/2003 |
| WO | WO-03/039579 | | 5/2003 |
| WO | WO-2004/021861 | | 3/2004 |
| WO | WO-2004/056384 | | 7/2004 |
| WO | WO-2004/063337 | | 7/2004 |
| WO | WO-2004/092410 | | 10/2004 |
| WO | WO-2005/024006 | | 3/2005 |
| WO | WO-2005/029089 | | 3/2005 |
| WO | WO-2005/049070 | | 6/2005 |
| WO | WO-2005/051985 | | 6/2005 |
| WO | WO-2005/107795 | | 11/2005 |
| WO | WO-2005/115442 | | 12/2005 |
| WO | WO-2005/117912 | | 12/2005 |
| WO | WO-2005/123916 | | 12/2005 |
| WO | WO-2006/008267 | | 1/2006 |
| WO | WO-2006/023397 | | 3/2006 |
| WO | WO-2005/003261 | | 6/2006 |
| WO | WO-2006/089966 | | 8/2006 |
| WO | WO-2006/096345 | | 9/2006 |
| WO | WO-2006/128497 | | 12/2006 |
| WO | WO-2007/014749 | | 2/2007 |
| WO | WO-2007/072012 | | 6/2007 |
| WO | WO-2007/127834 | | 11/2007 |
| WO | WO-2007/127841 | | 11/2007 |
| WO | WO-2008/022806 | | 2/2008 |
| WO | WO-2008/087488 | | 7/2008 |
| WO | WO-2008/103234 | | 8/2008 |
| WO | WO-2008/117179 | | 10/2008 |
| WO | WO-2008/127654 | | 10/2008 |
| WO | WO-2009/042962 | | 4/2009 |
| WO | WO-2009/061697 | | 5/2009 |
| WO | WO-2009/080054 | | 7/2009 |
| WO | WO-2010/007140 | | 1/2010 |
| WO | WO-2010/015668 | | 2/2010 |
| WO | WO-2010/016634 | | 2/2010 |
| WO | WO-2010/017196 | | 2/2010 |

OTHER PUBLICATIONS

Yun et al., Proteolytic inactivation of tissue factor pathway inhibitor by bacterial omptims. *Blood*, 113(5): 1139-48 (2008).

International Search Reporting and Written Opinion of the International Searching Authority, PCT/US2009/69060, United States Patent and Trademark Office, dated Jul. 28, 2010.

Piro et al., Role for the Kunitz-3 domain of tissue factor pathway inhibitor-in cell surface binding. *Circulation*, 110: 3567-72 (2004).

International Search Reporting and Written Opinion of the International Searching Authority, PCT/US2011/024604, European Searching Authority, dated Sep. 14, 2011.

Adams et al., Anti-tissue factor pathway inhibitor activity in patients with primary antiphospholipid syndrome. *Br. J. Haematol.* 114(2): 375-9 (2001).

Audu et al., The impact of tissue factor pathway inhibitor on coagulation kinetics determined by thrombelastography. *Anesth. Analg.,* 103(4): 841-5 (2006).

Bi et al., Targeted disruption of the mouse factor VIII gene produces a model of haemophilia A. *Nat. Genet.,* 10(1): 119-21 (1995).

Cawthern et al., Blood coagulation in hemophilia A and hemophilia C. *Blood*, 91(12): 4581-92 (1998).

Davis et al., Preparation and characterization of antibodies with specificity for the amino-terminal, tetrapeptide sequence of the platelet-derived connective tissue activating peptide-III. *Biochem. Intl.,* 10: 394-414 (1985).

Erhardtsen et al., Blocking of tissue factor pathway inhibitor (TFPI) shortens the bleeding time in rabbits with antibody induced haemophilia A. *Blood Coagul. Fibrinolysis*, 6(5): 388-95 (1995).

Hemker et al., Calibrated automated thrombin generation measurement in clotting plasma. *Pathophysiol. Haemost. Thromb.* 33: 4-15 (2003).

Larsen et al., The Merrifield peptide synthesis studied by near-infrared Fourier-tranform Raman spectroscopy. *J. Am. Chem. Soc.,* 115: 6247 (1993).

Lindhout et al., Kinetics of the inhibition of tissue factor-factor VIIa by tissue factor pathway inhibitor. *Thromb. Haemost.* 74: 910-5 (1995).

Liu et al., Optimized synthesis of RNA-protein fusions for invitro protein selection. *Methods Enzymol.* 318: 268-93 (2000).

Lozier et al., The chapel hill hemophilia a dog colony exhibits a factor VII gene inversion. *Proc. Natl. Acad. Sci USA.* 99: 12991-6 (2002).

Mackman et al., Role of the extrinsic pathway of blood coagulation in hemostasis and thrombosis. *Arterioscler. Thromb. Vasc. Biol.*, 27, 1687-93 (2007).

Merrifield, Solid phase peptide synthesis. I. The synthesis of a tetrapeptide. *J. Am. Chem. Soc.,* 85: 2149-54 (1963).

Meziere et al, In vivo T helper cell response to retro-inverso peptidomimetics. *J. Immunol.,* 159: 3230-7 (1997).

O'Donnell et al., Solid-phase unnatural peptide synthesis (UPS). *J. Am. Chem. Soc.,* 118: 6070 (1996).

Panteleev et al., Tissue factor pathway inhibitor: A possible mechanism of action. *Eur. J. Biochem.* 249: 2016-31 (2002).

Peerlinck et al., Epidemiology of inhibitor formation with recombinant factor VIII replacement therapy. *Haemophilia*, 12: 579-90 (2006).

Salemink et al., Antibodies to beta2-glycoprotein I associated with antiphospholipid syndrome suppress the inhibitory activity of tissue factor pathway inhibbitor. *Throm. Haemost.* 84(4):653-6 (2008).
Shen et al., The effects of injection of human factor VIII antibody into rabbits. *Blood,* 42(4): 509-521 (1973).
Smith et al., Solid-phase peptide synthesis and biological activity of bovine thymopoietin II (bTP-II). *Int. J. Pept. Protein Res.* 44: 183-91 (1994).
Sprecher et al., Molecular cloning, expression, and partial characterization of a second human tissue-factor-pathway inhibitor. *Proc. Natl. Acad. Sci USA*. 91: 3353-7 (1994).
Tranholm et al., Improved hemostasis with superactive analogs of factor VIIa in a mouse model of hemophilia A. *Blood*, 102: 3615-20 (2003).
Wang et al., A factor IX-deficient mouse model for hemophilia B gene therapy. *Proc. Natl. Acad. Sci. USA*. 94(21): 11563-66 (1997).
Yang et al., Preparation and characterization of monoclonal antibody against recombinant human tissue factor pathway inhibitor. *Chin. Med. J.* 111(8): 718-21 (1998).
Dockal et al., Peptides binding to Kunitz domain 1 of Tissue Factor Pathway Inhibitor (TFPI) inhibit all functions of TFPI and improve thrombin generation of hemophilia plasma. *Blood*, 118(21): 976-7 (2011).
Gerhard et al., The status, quality, and expansion of the NIH full-length cDNA project: The mammalian gene collection (MGC). *Genome Res*., 14(10B): 2121-7 (2004).
Jian et al., Cloning, expression and characterization of translationally controlled tumor protein (TCTP) gene from flatfish turbot (*Scophthalmus maximus*). *J. Ocean Univ. China*, 7(2): 184-92 (2008).
Johnson et al., The genome sequence of avian pathogenic *Escherichia coli* strain 01: K1: H7 shares strong similarities with human extraintestinal pathogenic *E-coli* genomes. *J. Bacteriology*, 189(8): 3228-36 (2007).
UniProt Database Accession No. A1ACU8, Putative uncharacterized protein, dated Jan. 23, 2007.
UniProt Database Accession No. Q20216, Translationally-controlled tumor protein homolog, dated Apr. 18, 2006.
UniProt Database Accession No. Q99M74, Keratin, type II cuticular Hb2, dated Mar. 29, 2004.
Supplementary European Search Report, European Patent Application No. 09833887.4, mailed Aug. 8, 2012.

* cited by examiner

| | | |
|---|---|---|
| Base Sequence JBT0293 | FQSKKNVFVFGYFERLRAKL | (SEQ ID NO: 256) |
| JBT0294 | Ac-**Y**QSKKNVFVFGYFERLRAKL-NH2 | (SEQ ID NO: 257) |
| JBT0295 | Ac-F**S**SKKNVFVFGYFERLRAKL-NH2 | (SEQ ID NO: 713) |
| JBT0296 | Ac-FQ**N**KKNVFVFGYFERLRAKL-NH2 | (SEQ ID NO: 407) |
| JBT0297 | Ac-FQSK**N**NVFVFGYFERLRAKL-NH2 | (SEQ ID NO: 183) |
| JBT0298 | Ac-FQSK**Q**NVFVFGYFERLRAKL-NH2 | (SEQ ID NO: 747) |
| JBT0299 | Ac-FQSKKNVF**A**FGYFERLRAKL-NH2 | (SEQ ID NO: 408) |
| JBT0300 | Ac-FQSKKNVF**S**FGYFERLRAKL-NH2 | (SEQ ID NO: 409) |
| JBT0301 | Ac-FQSKKNVF**T**FGYFERLRAKL-NH2 | (SEQ ID NO: 410) |
| JBT0302 | Ac-FQSKKNVFV**A**GYFERLRAKL-NH2 | (SEQ ID NO: 258) |
| JBT0303 | Ac-FQSKKNVFV**D**GYFERLRAKL-NH2 | (SEQ ID NO: 184) |
| JBT0304 | Ac-FQSKKNVFV**L**GYFERLRAKL-NH2 | (SEQ ID NO: 259) |
| JBT0305 | Ac-FQSKKNVFV**Q**GYFERLRAKL-NH2 | (SEQ ID NO: 260) |
| JBT0306 | Ac-FQSKKNVFV**S**GYFERLRAKL-NH2 | (SEQ ID NO: 185) |
| JBT0307 | Ac-FQSKKNVFV**Y**GYFERLRAKL-NH2 | (SEQ ID NO: 261) |
| JBT0308 | Ac-FQSKKNVFVFGY**K**ERLRAKL-NH2 | (SEQ ID NO: 411) |
| JBT0309 | Ac-FQSKKNVFVFGY**Y**ERLRAKL-NH2 | (SEQ ID NO: 412) |
| JBT0310 | Ac-FQSKKNVFVFGYF**D**RLRAKL-NH2 | (SEQ ID NO: 262) |
| JBT0311 | Ac-FQSKKNVFVFGYFERLRAK**N**-NH2 | (SEQ ID NO: 748) |

| JBT-0047 | | Progress Curves of Inhibition of FXa | | | Extrinsic Tenase Inhibition by TFPI | | Factor IIa Generation | | |
|---|---|---|---|---|---|---|---|---|---|
| **PEPTIDE** | **SEQUENCE** | $EC_{50}$ (μM) | % Inhibit (Max) | % Inhibit (2.5μM) | $EC_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| **JBT0047** | Ac-SGVGRLQVAFQSKKNVFVFGYFERLRAKLTS-NH2 (SEQ ID NO: 253) | --- | | NA | --- | NA | 123 | 122 | |
| | | --- | | NA | 1.23 | NA | | | |
| | | --- | | NA | --- | NA | | | |
| | | --- | | NA | 2.98 | 16 | | | |
| | | 0.72 | 82.4 | 68 | | | | | |
| | | | | NA | | | | | |
| | | --- | | 49 | | | | | |
| **JBT0047** | Ac-SGVGRLQVAFQSKKNVFVFGYFERLRAKLTS-NH2 (SEQ ID NO: 253) | --- | | NA | 1.37 | 20 | 128 | 289 | 68 |
| | | 1.33 | 63.10 | 35 | 1.46 | 26 | | | |
| | | | | | | | 160 | | |
| | | | | | | | 155 | | |
| **JBT0047** | Ac-SGVGRLQVAFQSKKNVFVFGYFERLRAKLTS-NH2*HCL (SEQ ID NO: 253) | | | | | | | | |

FIGURE 12B

| | | | | | | | | | |
|---|---|---|---|---|---|---|---|---|---|
| **JBT0051** | Biotin-Ttds-SGVGRLQVAFQSKKNVFVFGYFERLRAKLTS-NH2 (SEQ ID NO: 962) | --- | | NA | 2.49 | NA | | | |
| | | 0.53 | 86.9 | 66 | 1.04 | 19 | | | |
| **JBT0055** | Ac-SGVGRLQVAFQSKKNVFVFGYFERLRAKLTS-Ttds-Lysin(biotin)-NH2 (SEQ ID NO: 963) | --- | | NA | --- | NA | | | |
| | | --- | | NA | --- | NA | | | |
| | | --- | | NA | --- | NA | | | |
| | | --- | | NA | | 18 | | | |
| | | 0.53 | 88.4 | 72 | 1.67 | 25 | | | |
| | | --- | | NA | | | | | |
| **JBT0055** | Ac-SGVGRLQVAFQSKKNVFVFGYFERLRAKLTS-Ttds-Lysin(biotin)-NH2 (SEQ ID NO: 963) | --- | | NA | | | | | |
| **JBT0131** | Biotin-Ttds-AFQSKKNVFVFGYFERLRAK-NH2 (SEQ ID NO: 964) | --- | | NA | 2.02 | 11 | 65 | 173 | |
| | | 8.20 | 77.80 | 23 | | | | | |
| **JBT0131** | Biotin-Ttds-AFQSKKNVFVFGYFERLRAK-NH2*HCl (SEQ ID NO: 964) | 10.52 | 72.06 | 12 | 1.67 | 14 | 106 | 45 | |
| | | --- | | 14 | 2.96 | 14 | | | |
| **JBT0132** | Biotin-Ttds-FQSKKNVFVFGYFERLRAKL-NH2 (SEQ ID NO: 965) | --- | | NA | 0.06 | 10 | 41 | 102 | |
| | | --- | | 44 | --- | 16 | 28 | | |
| | | 1.15 | 49.37 | 36 | | | | | |
| **JBT0132** | Biotin-Ttds-FQSKKNVFVFGYFERLRAKL-NH2 (SEQ ID NO: 965) | --- | | 23 | | 11 | 109 | | |

FIGURE 12C

| | | | | | | | | | |
|---|---|---|---|---|---|---|---|---|---|
| | | --- | | 27 | --- | 13 | 123 | 53 | |
| | | | | | | | 112 | | |
| **JBT0132** | Biotin-Ttds-FQSKKNVFVFGYFERLRAKL-NH2 (SEQ ID NO: 965) | --- | | 30 | --- | 11 | 117 | | |
| **JBT0133** | Biotin-Ttds-QSKKNVFVFGYFERLRAKLT-NH2 (SEQ ID NO: 966) | --- | | NA | 0.34 | 9 | 28 | 67 | |
| | | --- | | 15 | | | | | |
| **JBT0134** | Biotin-Ttds-QSKKNVFVFGYFERLRAK-NH2 (SEQ ID NO: 967) | --- | | NA | --- | 3 | 11 | -- | |
| | | --- | | 5 | | | | | |
| **JBT0155** | Ac-KKSGVGRLQVAFQSKKNVFVFGYFERLRAKLTSKK-NH2 (SEQ ID NO: 8) | --- | | 74 | 0.38 | 33 | 49 | | |
| | | 0.97 | 77.70 | 54 | | | 67 | | |
| **JBT0156*** | Ac-VVEKLTFVQLSFLNRRRFSQYAGFKGAGKV-NH2 (SEQ ID NO: 742) | --- | | 0 | --- | 18 | -- | | |
| | | | | | 1.49 | 14 | | | |
| **JBT0157*** | Ac-RVFLYFSGKAGGLVKLVERQAFQTNVSKFR-NH2 (SEQ ID NO: 743) | --- | | 0 | --- | 12 | -- | | |
| | | | | | --- | 9 | | | |
| | | | | | 2.77 | 9 | | | |
| **JBT0158** | Ac-KKSGVGRLQVAFQSKKNVFVFGYFERLRAKKK-NH2 (SEQ ID NO: 9) | --- | | 34 | --- | 23 | 30 | | |
| | | 4.26 | 88.20 | 35 | | | | | |
| **JBT0159** | Ac- | --- | | 0 | --- | 18 | inhib | | |

FIGURE 12D

| | | | | | | | | | |
|---|---|---|---|---|---|---|---|---|---|
| | KKSGVGRLQVAFQSKKNVFVFGYFERLKK-NH2 (SEQ ID NO: 744) | | | | | | | | |
| | | | | | --- | 22 | | | |
| **JBT0160** | Ac-KKSGVGRLQVAFQSKKNVFVFGYFKK-NH2 (SEQ ID NO: 745) | --- | | 0 | --- | 22 | inhib | | |
| **JBT0161** | Ac-KKSGVGRLQVAFQSKKNVFVFKK-NH2 (SEQ ID NO: 746) | --- | | 0 | --- | 6 | inhib | | |
| **JBT0162** | Ac-KKGRLQVAFQSKKNVFVFGYFERLRAKLTSKK-NH2 (SEQ ID NO: 10) | --- | | 68 | 0.28 | 34 | 54 | | |
| | | 0.74 | 70.70 | 54 | | | | | |
| **JBT0163** | Ac-KKQVAFQSKKNVFVFGYFERLRAKLTSKK-NH2 (SEQ ID NO: 11) | --- | | 66 | 0.89 | 31 | 69 | | |
| | | 1.54 | 79.30 | 48 | | | | | |
| **JBT0164** | Ac-KKFQSKKNVFVFGYFERLRAKLTSKK-NH2 (SEQ ID NO: 12) | --- | | 55 | 2.68 | 24 | 39 | | |
| | | --- | | 50 | | | | | |
| | | 1.74 | 71.24 | 43 | | | | | |
| **JBT0165** | Ac-KKKKNVFVFGYFERLRAKLTSKK-NH2 (SEQ ID NO: 712) | --- | | 0 | --- | 15 | inhib | | |
| **JBT0166** | Biotinyl-Ttds-KKFQSKKNVFVFGYFERLRAKLKK-NH2 (SEQ ID NO: 968) | --- | | 71 | 1.95 | 36 | | | |
| | | --- | | 58 | | | | | |
| | | 2.60 | 85.60 | 50 | | | | | |
| **JBT0167*** | Biotinyl-Ttds-GKNAKFYLFESLRQVKFVFR-NH2 (SEQ ID NO: 969) | --- | | 0 | --- | 21 | -- | | |

FIGURE 12E

| | | | | | | | | | |
|---|---|---|---|---|---|---|---|---|---|
| | | | | | --- | 19 | | | |
| | | | | | --- | 15 | | | |
| **JBT0168*** | Biotinyl-Ttds-YKFSFNKELFKQARLRFVGV-NH2 (SEQ ID NO: 970) | --- | | 0 | --- | 9 | -- | | |
| | | | | | --- | 2 | | | |
| **JBT0169** | Ac-KKAFQSKKNVFVFGYFERLRAKKK-NH2 (SEQ ID NO: 254) | --- | | 16 | 2.35 | 20 | 21 | | |
| | | --- | | 21 | | | | | |
| **JBT0170** | Ac-KKFQSKKNVFVFGYFERLRAKLKK-NH2 (SEQ ID NO: 13) | --- | | 61 | 1.90 | 30 | 68 | | |
| | | --- | | 49 | | | | | |
| | | --- | | 43 | | | | | |
| **JBT0171** | Ac-KKQSKKNVFVFGYFERLRAKLTKK -NH2 (SEQ ID NO: 255) | --- | | 25 | 4.12 | 13 | 33 | | |
| | | --- | | 29 | | | | | |
| **JBT0172** | Ac-KKQSKKNVFVFGYFERLRAKKK-NH2 (SEQ ID NO: 406) | --- | | 7 | 3.98 | 8 | -- | | |
| | | --- | | 14 | | | | | |
| **JBT0173** | Biotinyl-Ttds-SGVGRLQVAFQSKKNVFVFG-NH2 (SEQ ID NO: 971) | --- | | 0 | | 3 | | | |
| **JBT0174** | Ac-KKAFQSKKNVFVFGYFERLRAKLKK-NH2 (SEQ ID NO: 14) | --- | | 47 | 2.90 | 26 | 49 | | |
| | | --- | | 39 | | | | | |
| **JBT0175** | Ac-KKAFQSKKNVFVFGYFERLRAKLTKK-NH2 (SEQ ID NO: 182) | --- | | 45 | 2.29 | 26 | 49 | | |
| | | 2.71 | 78.67 | 40 | | | | | |
| | | | | | --- | 1 | | | |

FIGURE 12F

| | | | | | | | | | |
|---|---|---|---|---|---|---|---|---|---|
| | | | | | --- | 3 | | | |
| **JBT0293** | Ac-FQSKKNVFVFGYFERLRAKL-NH2 (SEQ ID NO: 256) | --- | | 28 | | 12 | 119 | | |
| | | 1.32 | 40.6 | 27 | 2.93 | 14 | 147 | 71 | |
| | | 1.69 | 44.11 | 27 | --- | 13 | 135 | | |
| | | --- | | 29 | --- | 15 | 132 | | |
| | | 1.94 | 39.5 | 22 | --- | 16 | | | |
| **JBT0293** | Ac-FQSKKNVFVFGYFERLRAKL-NH2 (SEQ ID NO: 256) | --- | | 27 | 1.62 | 16 | | | |
| | | 5.37 | 78.1 | 26 | | | | | |
| **JBT0294** | Ac-YQSKKNVFVFGYFERLRAKL-NH2 (SEQ ID NO: 257) | --- | | 46 | | 12 | 122 | | |
| | | 4.07 | 101.07 | 40 | 5.31 | 9 | 169 | 82 | |
| **JBT0295** | Ac-FSSKKNVFVFGYFERLRAKL-NH2 (SEQ ID NO: 713) | --- | | 2 | | 13 | inhib | | |
| | | | | | 1.80 | 10 | | | |
| **JBT0296** | Ac-FQNKKNVFVFGYFERLRAKL-NH2 (SEQ ID NO: 407) | --- | | 25 | | 6 | 79 | | |
| | | 4.91 | 69.35 | 19 | 7.83 | 10 | | | |
| **JBT0297** | Ac-FQSKNNVFVFGYFERLRAKL-NH2 (SEQ ID NO: 183) | --- | | 67 | --- | 13 | 147 | | |
| | | 0.63 | 67.87 | 59 | --- | 14 | 206 | 113 | |
| | | 0.44 | 58.5 | 56 | --- | 7 | 170 | | |
| | | 1.1 | 60.6 | 41 | --- | 14 | 197 | | |
| **JBT0298** | Ac-FQSKQNVFVFGYFERLRAKL-NH2 (SEQ ID NO: 747) | --- | | 45 | --- | 15 | 109 | | |
| | | 1.83 | 71.69 | 42 | --- | 17 | | | |

FIGURE 12G

| | | | | | | | | | |
|---|---|---|---|---|---|---|---|---|---|
| **JBT0299** | Ac-FQSKKNVFAFGYFERLRAKL-NH2 (SEQ ID NO: 408) | --- | | 13 | --- | 5 | 63 | | |
| | | 15.31 | 73.69 | 9 | --- | 6 | | | |
| **JBT0300** | Ac-FQSKKNVFSFGYFERLRAKL-NH2 (SEQ ID NO: 409) | --- | | 7 | --- | 3 | 40 | | |
| **JBT0301** | Ac-FQSKKNVFTFGYFERLRAKL-NH2 (SEQ ID NO: 410) | --- | | 9 | --- | 0 | 49 | | |
| **JBT0302** | Ac-FQSKKNVFVAGYFERLRAKL-NH2 (SEQ ID NO: 258) | --- | | 55 | --- | 3 | 220 | | |
| | | 2.10 | 90.94 | 47 | --- | 6 | 249 | 185 | |
| | | 2.6 | 68.2 | 33 | --- | 8 | 218 | | |
| **JBT0303** | Ac-FQSKKNVFVDGYFERLRAKL-NH2 (SEQ ID NO: 184) | --- | | 61 | --- | 7 | 253 | | |
| | | 1.16 | 93.12 | 61 | --- | 8 | 250 | 218 | |
| | | 0.92 | 78.01 | 54 | --- | 7 | 244 | | |
| | | | | | 11.16 | 7 | 239 | | |
| **JBT0303** | Ac-FQSKKNVFVDGYFERLRAKL-NH2 (SEQ ID NO: 184) | 1.76 | 77.5 | 45 | 8.8 | 9 | | | |
| **JBT0304** | Ac-FQSKKNVFVLGYFERLRAKL-NH2 (SEQ ID NO: 259) | --- | | 35 | --- | 7 | 138 | | |
| | | 2.95 | 75.15 | 32 | 12.87 | 7 | | | |
| **JBT0305** | Ac-FQSKKNVFVQGYFERLRAKL-NH2 (SEQ ID NO: 260) | --- | | 46 | --- | 0 | 207 | | |
| | | 2.28 | 87.92 | 45 | --- | 5 | 223 | 205 | |
| | | 3.15 | 65.6 | 27 | --- | 4 | 207 | | |
| **JBT0306** | Ac-FQSKKNVFVSGYFERLRAKL-NH2 (SEQ ID NO: 185) | --- | | 42 | --- | 3 | 197 | | |
| | | 3.56 | 94.28 | 37 | --- | 2 | 204 | 174 | |

FIGURE 12H

| | | | | | | | | | |
|---|---|---|---|---|---|---|---|---|---|
| | | 3.89 | 71.4 | 28 | --- | 5 | 247 | | |
| **JBT0307** | Ac-FQSKKNVFVYGYFERLRAKL-NH2 (SEQ ID NO: 261) | --- | | 38 | --- | 7 | 151 | | |
| | | 3.42 | 85.15 | 34 | 8.72 | 4 | 182 | 168 | |
| | | 3.01 | 60.2 | 26 | --- | 9 | 182 | | |
| **JBT0308** | Ac-FQSKKNVFVFGYKERLRAKL-NH2 (SEQ ID NO: 411) | --- | | 9 | --- | 4 | 133 | | |
| **JBT0309** | Ac-FQSKKNVFVFGYYERLRAKL-NH2 (SEQ ID NO: 412) | --- | | 21 | --- | 7 | 123 | | |
| | | 4.50 | 66.79 | 19 | 8.55 | 7 | | | |
| **JBT0310** | Ac-FQSKKNVFVFGYFDRLRAKL-NH2 (SEQ ID NO: 262) | --- | | 31 | --- | 5 | 142 | | |
| | | 3.86 | 70.81 | 26 | 16.98 | 3 | 152 | | |
| | | 2.11 | 47.68 | 24 | --- | 4 | 163 | | |
| | | 3.37 | 48.8 | 19 | --- | 5 | | | |
| **JBT0311** | Ac-FQSKKNVFVFGYFERLRAKN-NH2 (SEQ ID NO: 748) | --- | | 5 | --- | 5 | 27 | | |
| | | 44.92 | 68.81 | 5 | 3.72 | 10 | | | |
| **JBT0335** | Ac-FQSKKNVFVFGYFERLRAK-NH2 (SEQ ID NO: 749) | 6.2 | 16.4 | 2 | 10.48 | 5 | 28 | | |
| **JBT0336** | Ac-FQSKNNVFVAGYFDRLRAKL-OH (SEQ ID NO: 263) | 6.52 | 63 | 19 | 12.13 | 5 | 186 | | |
| | | | | | | | 181 | | |
| **JBT0337** | Ac-FQSKNNVFVDGYFDRLRAKL-NH2 (SEQ ID NO: 16) | 0.71 | 69.1 | 51 | 13.33 | 15 | 219 | | |
| **JBT0338** | Ac-FQSKNNVFVQGYFDRLRAKL-NH2 (SEQ ID NO: 17) | 1.12 | 60.9 | 40 | 8.42 | 9 | 197 | | |
| **JBT0339** | Ac-FQSKNNVFVSGYFDRLRAKL-NH2 (SEQ ID | 1.22 | 66.9 | 42 | 19.1 | 9 | 230 | | |

FIGURE 12I

| | | | | | | | | | |
|---|---|---|---|---|---|---|---|---|---|
| | NO: 18) | | | | | | | | |
| | | | | | | | 231 | | |
| **JBT0340** | Ac-FQSKNNVFVYGYFDRLRAKL-NH2 (SEQ ID NO: 186) | 1.87 | 66 | 37 | 26.12 | 9 | 197 | | |
| **JBT0341** | Ac-FQSKNNVFVFGYFDRLRAKL-NH2 (SEQ ID NO: 187) | 1.08 | 54.1 | 38 | 8.68 | 10 | 193 | | |
| **JBT0342** | Ac-FQSKNNVFVDGYFERLRAKL-NH2 (SEQ ID NO: 19) | 0.38 | 65.8 | 58 | 7.15 | 18 | 244 | | |
| | | | | | | | 241 | | |
| **JBT0343** | Ac-FQSKKNVFVDGYFDRLRAKL-NH2 (SEQ ID NO: 188) | 1.08 | 54.1 | 34 | 42.24 | 8 | 239 | | |
| | | 2.21 | 82 | 42 | | | | | |
| **JBT0374** | Ac-FQSKDNVFVFGYFERLRAKL-NH2 (SEQ ID NO: 20) | --- | | 47 | --- | 5 | 216 | | |
| | | 0.64 | 56.9 | 49 | 20.22 | 19 | | | |
| **JBT0375** | Ac-FQSKGNVFVFGYFERLRAKL-NH2 (SEQ ID NO: 190) | --- | | 57 | --- | 14 | 224 | | |
| | | --- | | 70 | 2.93 | 30 | | | |
| | | 0.31 | 62.1 | 61 | | | | | |
| **JBT0375** | Ac-FQSKGNVFVFGYFERLRAKL-NH2 (SEQ ID NO: 190) | --- | | 53 | --- | 19 | | | |
| **JBT0376** | Ac-FQSKKNAFVFGYFERLRAKL-NH2 (SEQ ID NO: 414) | --- | | 11 | --- | 3 | 101 | | |
| **JBT0377** | Ac-FQSKKNQFVFGYFERLRAKL-NH2 (SEQ ID NO: 264) | --- | | 20 | --- | 8 | 180 | | |
| **JBT0378** | Ac-FQSKKNVFVEGYFERLRAKL-NH2 (SEQ ID NO: 21) | --- | | 41 | --- | 7 | 245 | | |
| | | 1.59 | 79.1 | 44 | 9.03 | 12 | | | |

FIGURE 12J

| | | | | | | | | | |
|---|---|---|---|---|---|---|---|---|---|
| **JBT0379** | Ac-FQSKKNVFVTGYFERLRAKL-NH2 (SEQ ID NO: 22) | --- | | 31 | --- | 6 | 226 | | |
| | | 3.13 | 81.8 | 36 | 47,85 ?? | 12 | | | |
| **JBT0380** | Ac-FQSKKNVFVVGYFERLRAKL-NH2 (SEQ ID NO: 191) | --- | | 27 | --- | 6 | 199 | | |
| | | 2.59 | 73.1 | 34 | 7.58 | 10 | | | |
| **JBT0381** | Ac-FQSPKNVFVFGYFERLRAKL-NH2 (SEQ ID NO: 265) | --- | | 30 | --- | 9 | 173 | | |
| | | no fit | | 34 | no fit | 11 | | | |
| **JBT0385** | Ac-FQSKKNNFVFGYFERLRAKL-NH2 (SEQ ID NO: 672) | --- | | 0 | --- | 2 | --- | | |
| **JBT0386** | Ac-FQSKKNPFVFGYFERLRAKL-NH2 (SEQ ID NO: 415) | --- | | 6 | --- | 5 | 85 | | |
| **JBT0388** | Ac-FQSKKNVHVFGYFERLRAKL-NH2 (SEQ ID NO: 192) | --- | | 25 | --- | 6 | 185 | | |
| | | 4.34 | 72.5 | 26 | no fit | 9 | | | |
| **JBT0389** | Ac-FQSKKNVVVFGYFERLRAKL-NH2 (SEQ ID NO: 673) | --- | | 0 | --- | 8 | 34 | | |
| **JBT0390** | Ac-FQSKKNVFQFGYFERLRAKL-NH2 (SEQ ID NO: 674) | --- | | 0 | --- | 5 | 28 | | |
| **JBT0391** | Ac-FQSKKNVFVGGYFERLRAKL-NH2 (SEQ ID NO: 266) | --- | | 12 | --- | 1 | 178 | | |
| | | 7.02 | 73.8 | 18 | --- | 1 | | | |
| **JBT0392** | Ac-FQSKKNVFVHGYFERLRAKL-NH2 (SEQ ID NO: 23) | --- | | 32 | --- | 4 | 228 | | |
| | | 2.48 | 74.4 | 37 | --- | 6 | | | |
| **JBT0393** | Ac-FQSKKNVFVKGYFERLRAKL-NH2 (SEQ ID | --- | | 20 | --- | 3 | 268 | | |

FIGURE 12K

| | | | | | | | | | |
|---|---|---|---|---|---|---|---|---|---|
| | NO: 193) | | | | | | | | |
| | | 3.02 | 64.1 | 28 | --- | 1 | | | |
| **JBT0394** | Ac-FQSKKNVFVMGYFERLRAKL-NH2 (SEQ ID NO: 24) | --- | | 10 | --- | 7 | 115 | | |
| | | 6.83 | 57.3 | 12 | --- | 8 | | | |
| **JBT0395** | Ac-FQSKKNVFVNGYFERLRAKL-NH2 (SEQ ID NO: 25) | --- | | 28 | --- | 7 | 235 | | |
| | | 2.80 | 72.1 | 32 | no fit | 7 | | | |
| **JBT0396** | Ac-FQSKKNVFVPGYFERLRAKL-NH2 (SEQ ID NO: 194) | --- | | 22 | --- | 6 | 196 | | |
| | | 4.33 | 77.2 | 30 | 8.71 | 6 | | | |
| **JBT0397** | Ac-FQSKKNVFVRGYFERLRAKL-NH2 (SEQ ID NO: 195) | --- | | 24 | --- | 4 | 240 | | |
| | | 5.09 | 72.3 | 23 | 9,80 | 0 | | | |
| **JBT0398** | Ac-FQSKKNVFVFGYFEELRAKL-NH2 (SEQ ID NO: 196) | --- | | 4 | --- | 8 | -- | | |
| **JBT0399** | Ac-FQSKKNVFVFGYFELLRAKL-NH2 (SEQ ID NO: 750) | --- | | 0 | --- | 7 | -- | | |
| **JBT0400** | Ac-FQSKKNVFVFGYFLRLRAKL-NH2 (SEQ ID NO: 267) | --- | | 1 | --- | 13 | -- | | |
| **JBT0401** | Ac-FQSKKNVFVFGYFERLRAVL-NH2 (SEQ ID NO: 416) | --- | | 0 | --- | 4 | -- | | |
| **JBT0402** | Biotin-Ttds-FQSKNNVFVFGYFERLRAKL-NH2 (SEQ ID NO: 973) | 0.32 | 45.41 | 48 | --- | 11 | 185 | | |
| **JBT0403** | Biotin-Ttds-FQSKKNVFVDGYFERLRAKL-NH2 (SEQ ID NO: 972) | 0.49 | 64.39 | 59 | --- | 9 | 253 | | |
| | | --- | | 62 | | | | | |
| **JBT0404** | Biotin-Ttds-FQSKKNVFVFGYFDRLRAKL-NH2 | 1.89 | 42.89 | 24 | 3.38 | 14 | 115 | | |

FIGURE 12L

| | | | | | | | | | |
|---|---|---|---|---|---|---|---|---|---|
| | (SEQ ID NO: 974) | | | | | | | | |
| **JBT0405** | Biotin-FQSKKNVFVFGYFERLRAKL-NH2<br>(SEQ ID NO: 975) | 0.86 | 81.33 | 59 | --- | 15 | 142 | | |
| **JBT0406** | Ac-Ttds-FQSKKNVFVFGYFERLRAKL-NH2<br>(SEQ ID NO: 268) | --- | | 28 | --- | 9 | 114 | | |

FIGURE 13A

| JBT-0049 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | $EC_{50}$ (µM) | % Inhibit (Max) | % Inhibit (2.5µM) | $EC_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0049 | Ac-SGNTFVDERLLYFLTIGNMGMYAAQLKFRTS-NH2 (SEQ ID NO: 3025) | --- | | NA | --- | NA | | 12 | 12 |
| | | --- | | NA | --- | 17 | 36 | 44 | |
| | | --- | | NA | --- | 11 | | | |
| | | --- | | NA | | | | | |
| | | --- | | 17 | | | | | |
| JBT0049 | Ac-SGNTFVDERLLYFLTIGNMGMYAAQLKFRTS-NH2 (SEQ ID NO: 3025) | --- | | 10 | --- | 13 | 49 | 17 | |
| | | --- | | 19 | --- | 8 | 42 | | |
| | | | | | | | 53 | | |
| JBT0053 | Biotin-Ttds-SGNTFVDERLLYFLTIGNMGMYAAQLKFRTS-NH2 (SEQ ID NO: 3006) | --- | | NA | --- | 11 | | | |
| | | --- | | NA | | | | | |
| | | --- | | 18 | | | | | |
| JBT0057 | Ac-SGNTFVDERLLYFLTIGNMGMYAAQLKFRTS-Ttds-Lysin(biotin)-NH2 (SEQ ID NO: 3018) | --- | | NA | --- | 15 | | | |
| | | --- | | NA | | | | | |
| | | --- | | 15 | | | | | |
| JBT0135 | Biotin-Ttds-LLYFLTIGNMGMYAAQLKFR-NH2 (SEQ ID NO: 3021) | --- | | NA | --- | 10 (0,625µ | | | |

FIGURE 13B

| | | | | | | | | | |
|---|---|---|---|---|---|---|---|---|---|
| | | | | | | M) | | | |
| | | --- | | 0 | | | | | |
| **JBT0136** | Biotin-Ttds-LYFLTIGNMGMYAAQLKFRT-NH2 (SEQ ID NO: 3014) | --- | | NA | --- | 11 (0,625µ M) | | | |
| | | --- | | 0 | | | | | |
| **JBT0137** | Biotin-Ttds-YFLTIGNMGMYAAQLKFRTS-NH2 (SEQ ID NO: 3013) | --- | | 0 | --- | 2 | | | |
| **JBT0138** | Biotin-Ttds-YFLTIGNMGMYAAQLKFR-NH2 (SEQ ID NO: 3012) | --- | | 0 | --- | 4 | | | |
| **JBT0190** | Ac-KKSGNTFVDERLLYFLTIGNMGMYAAQLKFRTSKK-NH2 (SEQ ID NO: 3031) | --- | | 21 | 0.49 | 32 | 80 | 72 | |
| | | --- | | 27 | | | 74 | | |
| **JBT0191*** | Ac-MLGVLMRGISALTGDYTARFEFYLNKQTFN-NH2 (SEQ ID NO: 3054) | --- | | 0 | --- | 0 | | | |
| **JBT0192*** | | | | | | | | | |
| **JBT0193** | Ac-KKSGNTFVDERLLYFLTIGNMGMYAAQLKFKK-NH2 (SEQ ID NO: 3073) | | | 51 | 1.26 | 38 | 140 | 114 | |
| | | 2.30 | 104.85 | 52 | | | 149 | | |
| **JBT0194** | Ac-KKSGNTFVDERLLYFLTIGNMGMYAAQKK-NH2 (SEQ ID NO: 3074) | --- | | 0 | --- | 8 | | | |
| **JBT0195** | Ac-KKSGNTFVDERLLYFLTIGNMGMYKK-NH2 (SEQ ID NO: 3075) | --- | | 0 | --- | 5 | | | |
| **JBT0196** | Ac-KKSGNTFVDERLLYFLTIGNMKK-NH2 (SEQ ID NO: 3048) | --- | | 0 | --- | 12 | | | |
| **JBT0197** | Ac-KKTFVDERLLYFLTIGNMGMYAAQLKFRTSKK-NH2 (SEQ ID NO: 3076) | --- | | 38 | 0.38 | 35 | 146 | | |
| | | 0.91 | 57.40 | 39 | | | | | |

FIGURE 13C

| | | | | | | | | | |
|---|---|---|---|---|---|---|---|---|---|
| **JBT0198** | Ac-KKDERLLYFLTIGNMGMYAAQLKFRTSKK-NH2 (SEQ ID NO: 3077) | --- | | 0 | --- | 17 | | | |
| **JBT0199** | Ac-KKLLYFLTIGNMGMYAAQLKFRTSKK-NH2 (SEQ ID NO: 3078) | --- | | 0 | --- | 20 | | | |
| | | | | | --- | 17 | | | |
| **JBT0200** | Ac-KKFLTIGNMGMYAAQLKFRTSKK-NH2 (SEQ ID NO: 3079) | --- | | 0 | --- | 9 | | | |
| **JBT0201** | Ac-KKLLYFLTIGNMGMYAAQLKFRKK-NH2 (SEQ ID NO: 3080) | --- | | 2 | --- | 23 | | | |
| | | | | | --- | 16 | | | |
| **JBT0202** | Ac-KKLYFLTIGNMGMYAAQLKFRTKK-NH2 (SEQ ID NO: 3081) | --- | | 0 | --- | 15 | | | |
| **JBT0203** | Ac-KKYFLTIGNMGMYAAQLKFRTSKK-NH2 (SEQ ID NO: 3082) | --- | | 0 | --- | 7 | | | |
| **JBT0204** | Ac-KKSGNTFVDERLLYFLTIGNMGKK-NH2 (SEQ ID NO: 3060) | --- | | 0 | --- | 5 | | | |
| | | | | | --- | 0 | | | |
| **JBT0243** | Ac-SGDTFVDERLLYFLTIGNMRMYAVQLKFRTS-NH2 (SEQ ID NO: 3085) | | | 39 | --- | 37 | | | |
| | | 0.51 | 41.53 | 37 | | | | | |
| **JBT0244** | Ac-SGDTFVDERLLYFLTTGNMRMYAVQLKFRTS-NH2 (SEQ ID NO: 3086) | --- | | 50 | --- | 37 | | | |
| | | --- | | 49 | | | | | |
| **JBT0245** | Ac-SGDTFVDERLLYFLTIGDMRMYAVQLKFRTS-NH2 (SEQ ID NO: 3087) | --- | | 45 | --- | NA | | | |
| | | 0.44 | 50.53 | 44 | --- | 21 | | | |
| | | | | | --- | 24 | | | |
| **JBT0344** | Ac-TFVDERLLYFLTIGNMGMYAAQLKF-NH2 (SEQ ID NO: 3038) | --- | | 2 | --- | 1 | --- | | |

FIGURE 13D

| | | | | | | | | | |
|---|---|---|---|---|---|---|---|---|---|
| **JBT0345** | Ac-FVDERLLYFLTIGNMGMYAAQLKF-NH2 (SEQ ID NO: 3039) | --- | | 2 | --- | 2 | --- | | |
| **JBT0346** | Ac-VDERLLYFLTIGNMGMYAAQLKF-NH2 (SEQ ID NO: 3034) | --- | | 0 | --- | 2 | --- | | |
| **JBT0347** | Ac-TFVDERLLYFLTIGNMGMYAAQLK-NH2 (SEQ ID NO: 3040) | --- | | 2 | --- | 4 | --- | | |
| **JBT0348** | Ac-TFVDERLLYFLTIGNMGMYAAQ-NH2 (SEQ ID NO: 3084) | --- | | 0 | --- | 2 | --- | | |

FIGURE 14A

| JBT-0050 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | $EC_{50}$ (µM) | % Inhibit (Max) | % Inhibit (2.5µM) | $EC_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0050 | Ac-SGRGCTKVIVFTFRHNKLIGYERRYNCTS-NH2 (SEQ ID NO: 3047) | --- | | NA | --- | NA | | 81 | 21 |
| | | --- | | NA | 0.14 | 25 | 32 | 38 | |
| | | --- | | NA | --- | NA | 46 | | |
| | | --- | | NA | --- | NA | 46 | | |
| | | 0.95 | 56.6 | 39 | 0.05 | 33 | 49 | | |
| | | --- | | NA | | | | | |
| | | 1.14 | 58.99 | 35 | | | | | |
| JBT0050 | Ac-SGRGCTKVIVFTFRHNKLIGYERRYNCTS-NH2 (SEQ ID NO: 3047) | --- | | 33 | --- | 28 | 23 | | |
| | | 1.07 | 35,,6 | 26 | 0.14 | 19 | 27 | 36 | |
| JBT0054 | Biotin-Ttds-SGRGCTKVIVFTFRHNKLIGYERRYNCTS-NH2 (SEQ ID NO: 3002) | --- | | NA | 0.16 | NA | | | |
| | | 0.99 | 56.1 | 41 | 0.45 | 31 | | | |
| JBT0058 | Ac-SGRGCTKVIVFTFRHNKLIGYERRYNCTS-Ttds-Lysin(biotin)-NH2 (SEQ ID NO: 3003) | --- | | NA | --- | NA | | | |
| | | 1.07 | 60.9 | 42 | 0.37 | 28 | | | |
| JBT0129 | Ac-SGRGCTKVIVFTFRHNKLIGYERRYNCTS-NH2; Cycl. C5-C27 (SEQ ID NO: 3026) | --- | | NA | 0.16 | 21 | 27 | | |

FIGURE 14B

| | | | | | | | | | |
|---|---|---|---|---|---|---|---|---|---|
| | | --- | | 32 | | | 31 | 18 | |
| **JBT0130** | Biotin-Ttds-SGRGCTKVIVFTFRHNKLIGYERRYNCTS-NH2; cycl. C6-C28 (SEQ ID NO: 3001) | --- | | NA | 0.15 | 21 | | | |
| | | --- | | 34 | | | | | |
| **JBT0139** | Biotin-Ttds-GRGCTKVIVFTFRHNKLIGY-NH2 (SEQ ID NO: 3008) | --- | | NA | --- | 9 | -- | -- | |
| | | --- | | 7 (0,625µ M) | 0.10 | 15 | | | |
| **JBT0140** | Biotin-Ttds-GCTKVIVFTFRHNKLIGYER-NH2 (SEQ ID NO: 3010) | --- | | 0 | --- | 10 | 18 | 25 | |
| | | | | | 0.05 | NA | | | |
| **JBT0141** | Biotin-Ttds-CTKVIVFTFRHNKLIGYERR-NH2 (SEQ ID NO: 3009) | --- | | 0 | --- | 14 | 34 | 55 | |
| | | | | | 0.04 | NA | | | |
| **JBT0142** | Biotin-Ttds-TKVIVFTFRHNKLIGYERRY-NH2 (SEQ ID NO: 3022) | --- | | 0 | --- | 7 | 12 | -- | |
| | | | | | 1.96 | 12 | | | |
| **JBT0143** | Biotin-Ttds-KVIVFTFRHNKLIGYERRYN-NH2 (SEQ ID NO: 3023) | --- | | 7 | --- | 16 | 19 | -- | |
| | | --- | | 6 | 0.42 | 17 | | | |
| **JBT0144** | Biotin-Ttds-VIVFTFRHNKLIGYERRYNC-NH2 (SEQ ID NO: 3011) | --- | | NA | --- | 18 | -- | -- | |
| | | --- | | 0 | 0.03 | --- | | | |
| **JBT0145** | Biotin-Ttds-VIVFTFRHNKLIGYER-NH2 (SEQ ID NO: 3024) | --- | | 0 | --- | 5 | -- | -- | |
| **JBT0205** | Ac-KKSGRGCTKVIVFTFRHNKLIGYERRYNCTSKK-NH2 (SEQ ID NO: 3029) | --- | | 40 | --- | 34 | 134 | | |
| | | 1.64 | 87.46 | 49 | 0.11 | 36 | | | |
| **JBT0206*** | Ac-TNYTGSEKCIRFVTRRYLGVRINCFHKGS- | --- | | 0 | --- | 22 | -- | | |

FIGURE 14C

| | | | | | | | | | |
|---|---|---|---|---|---|---|---|---|---|
| | NH2 (SEQ ID NO: 3049) | | | | | | | | |
| | | | | | --- | 17 | | | |
| | | | | | 0.22 | 20 | | | |
| **JBT0207*** | Ac-TRNVVRRYECFGSTGCIKYFIHSRTGLNK-NH2 (SEQ ID NO: 3050) | --- | | 9 | --- | 8 | -- | | |
| | | | | | --- | 6 | | | |
| **JBT0208** | Ac-KKSGRGCTKVIVFTFRHNKLIGYERRYNKK-NH2 (SEQ ID NO: 3027) | --- | | 7 | --- | 18 | | | |
| | | | | | --- | 24 | | | |
| **JBT0209** | Ac-KKSGRGCTKVIVFTFRHNKLIGYERKK-NH2 (SEQ ID NO: 3051) | --- | | 0 | --- | 17 | | | |
| **JBT0210** | Ac-KKSGRGCTKVIVFTFRHNKLIGKK-NH2 (SEQ ID NO: 3061) | --- | | 0 | --- | 17 | | | |
| | | | | | --- | 13 | | | |
| **JBT0211** | Ac-KKGCTKVIVFTFRHNKLIGYERRYNCTSKK-NH2 (SEQ ID NO: 3032) | --- | | 42 | --- | 31 | 182 | | |
| | | --- | | 48 | 0.04 | 35 | (250) | (650) | |
| **JBT0212** | Ac-KKKVIVFTFRHNKLIGYERRYNCTSKK-NH2 (SEQ ID NO: 3033) | --- | | 7 | --- | 23 | 49 | | |
| | | --- | | 19 | 0.05 | 24 | | | |
| **JBT0213** | Ac-KKVFTFRHNKLIGYERRYNCTSKK-NH2 (SEQ ID NO: 3083) | --- | | 0 | --- | 15 | | | |
| **JBT0214** | Ac-KKGRGCTKVIVFTFRHNKLIGYKK-NH2 (SEQ ID NO: 3052) | --- | | 0 | --- | 15 | | | |
| **JBT0215** | Ac-KKGCTKVIVFTFRHNKLIGYERKK-NH2 (SEQ ID NO: 3055) | --- | | 1 | --- | 16 | | | |
| **JBT0216** | Ac-KKCTKVIVFTFRHNKLIGYERRKK-NH2 (SEQ ID NO: 3053) | --- | | 6 | --- | 18 | | | |
| **JBT0217** | Ac-KKTKVIVFTFRHNKLIGYERRYKK-NH2 (SEQ ID NO: 3062) | --- | | 1 | 1.06 | 18 | | | |
| | | --- | | 11 | | | | | |

FIGURE 14D

| | | | | | | | | | |
|---|---|---|---|---|---|---|---|---|---|
| **JBT0218** | Ac-KKKVIVFTFRHNKLIGYERRYNKK-NH2 (SEQ ID NO: 3063) | --- | | 4 | 1.18 | 12 | | | |
| | | --- | | 12 | | | | | |
| **JBT0219** | Ac-KKVIVFTFRHNKLIGYERRYNCKK-NH2 (SEQ ID NO: 3030) | --- | | 8 | --- | 17 | 29 | | |
| | | --- | | 22 | 0.10 | 17 | | | |
| **JBT0220** | Ac-KKIVFTFRHNKLIGYERRYNCTKK-NH2 (SEQ ID NO: 3064) | --- | | 0 | --- | 15 | | | |
| | | | | | --- | 16 | | | |
| **JBT0349** | Ac-GCTKVIVFTFRHNKLIGYERRYNCTS-NH2 (SEQ ID NO: 3041) | --- | | 19 | --- | 28 | 54 | | |
| | | 1.63 | 27.6 | 17 | 0.18 | 13 | | | |
| **JBT0350** | Ac-CTKVIVFTFRHNKLIGYERRYNCTS-NH2 (SEQ ID NO: 3042) | --- | | 21 | --- | 26 | 55 | | |
| | | 1.65 | 33.8 | 18 | 0.27 | 16 | | | |
| **JBT0351** | Ac-TKVIVFTFRHNKLIGYERRYNCTS-NH2 (SEQ ID NO: 3043) | --- | | 1 | --- | 19 | 30 | | |
| | | no fit | | 0 | 0.21 | 8 | | | |
| **JBT0352** | Ac-GCTKVIVFTFRHNKLIGYERRYNCT-NH2 (SEQ ID NO: 3044) | --- | | 24 | --- | 24 | 65 | | |
| | | 1.34 | 26.3 | 19 | 0.35 | 18 | | | |
| **JBT0353** | Ac-GCTKVIVFTFRHNKLIGYERRYNC-NH2 (SEQ ID NO: 3045) | --- | | 28 | --- | 30 | 76 | | |
| | | 0.72 | 24.5 | 21 | 0.61 | 20 | | | |

FIGURE 15A

| JBT-0101 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | $EC_{50}$ (µM) | % Inhibit (Max) | % Inhibit (2.5µM) | $EC_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0052 | Biotin-Ttds-KKSGVWQTHPRYFWTMWPDIKGEVIVLFGTSKK-NH2 (SEQ ID NO: 3004) | --- | | NA | 0.22 | 20 | | | |
| | | --- | | NA | 0.39 | 23 | | | |
| | | 1.47 | 57.24 | 52 | | | | | |
| JBT0101 | Ac-KKSGVWQTHPRYFWTMWPDIKGEVIVLFGTSKK-NH2 (SEQ ID NO: 3036) | --- | | NA | --- | NA | 65 | 164 | 40 |
| | | --- | | NA | 1.42 | 22 | | | |
| | | 2.25 | 50.13 | 26 | 0.24 | 21 | | | |
| | | | | | --- | 20 | | | |
| | | | | | 0.17 | 22 | | | |
| JBT0101 | Ac-KKSGVWQTHPRYFWTMWPDIKGEVIVLFGTSKK-NH2 (SEQ ID NO: 3036) | 2.01 | 45.27 | 26 | --- | 19 | 68 | 38 | |
| | | --- | | NA | | | 60 | | |
| | | --- | | NA | | | | | |
| | | --- | | NA | | | | | |
| | | 1.51 | 44.8 | 31 | | | | | |
| JBT0101 | Ac-KKSGVWQTHPRYFWTMWPDIKGEVIVLFGTSKK-NH2 (SEQ ID NO: 3036) | --- | | 29 | --- | 19 | | | |

FIGURE 15B

| | | | | | | | | | |
|---|---|---|---|---|---|---|---|---|---|
| | | --- | | 18 | 0.25 | 14 | | | |
| | | 1.94 | 37.47 | 19 | 0.61 | 19 | | | |
| **JBT0103** | Ac-KKSGVWQTHPRYFWTMWPDIKGEVIVLFGTS-Ttds-KKLysin(biotin)-NH2 (SEQ ID NO: 3005) | --- | | NA | 0.19 | 21 | | | |
| | | 1.69 | 38.91 | 24 | 0.17 | 17 | | | |
| **JBT0176*** | Ac-KKVGSVTRWSMYGPIFIKFTWTLEQPVGWDHKK-NH2 (SEQ ID NO: 3056) | --- | | 0 | --- | 17 | 150 | | |
| | | | | | --- | 16 | | | |
| **JBT0177*** | Ac-KKLTGDWTYFWSKVIWGPGVIERQMPVSTFHKK-NH2 (SEQ ID NO: 3065) | --- | | 4 | --- | 15 | -- | | |
| | | | | | --- | 10 | | | |
| | | | | | --- | 10 | | | |
| **JBT0178** | Ac-KKSGVWQTHPRYFWTMWPDIKGEVIVLFGTKK-NH2 (SEQ ID NO: 3028) | | | 42 | --- | 23 | 190 | 80 | |
| | | 1.51 | 65.93 | 42 | 0.20 | 26 | 111 | | |
| **JBT0179** | Ac-KKSGVWQTHPRYFWTMWPDIKGEVIVLKK-NH2 (SEQ ID NO: 3066) | --- | | 0 | --- | 14 | | | |
| **JBT0180** | Ac-KKSGVWQTHPRYFWTMWPDIKGEVKK-NH2 (SEQ ID NO: 3067) | --- | | 0 | --- | 5 | | | |
| **JBT0181** | Ac-KKSGVWQTHPRYFWTMWPDIKKK-NH2 (SEQ ID NO: 3068) | --- | | 0 | --- | 2 | | | |
| **JBT0182** | Ac-KKGVWQTHPRYFWTMWPDIKGEVIVLFGTSKK-NH2 (SEQ ID NO: 3037) | --- | | 39 | 0.26 | 27 | 146 | | |
| | | 0.62 | 52.16 | 40 | | | | | |
| **JBT0183** | Ac-KKQTHPRYFWTMWPDIKGEVIVLFGTSKK-NH2 (SEQ ID NO: 3069) | --- | | 0 | --- | 19 | | | |

FIGURE 15C

| | | | | | | | | | |
|---|---|---|---|---|---|---|---|---|---|
| **JBT0184** | Ac-KKPRYFWTMWPDIKGEVIVLFGTSKK-NH2 (SEQ ID NO: 3070) | --- | | 0 | --- | 26 | | | |
| | | | | | --- | 16 | | | |
| **JBT0185** | Ac-KKFWTMWPDIKGEVIVLFGTSKK-NH2 (SEQ ID NO: 3057) | --- | | 0 | --- | 14 | | | |
| **JBT0186** | Ac-KKSGVWQTHPRYFWTMWPDIKGKK-NH2 (SEQ ID NO: 3071) | --- | | 0 | --- | 3 | | | |
| **JBT0187** | Ac-KKWQTHPRYFWTMWPDIKGEVIKK-NH2 (SEQ ID NO: 3072) | --- | | 0 | --- | 5 | | | |
| **JBT0188** | Ac-KKHPRYFWTMWPDIKGEVIVLFKK-NH2 (SEQ ID NO: 3058) | --- | | 0 | --- | 21 | | | |
| | | | | | --- | 17 | | | |
| **JBT0189** | Ac-KKYFWTMWPDIKGEVIVLFGTSKK-NH2 (SEQ ID NO: 3059) | --- | | 0 | --- | 19 | | | |
| **JBT0354** | Ac-KKGVWQTHPRYFWTMWPDIKGEVIVLFGTKK-NH2 (SEQ ID NO: 3088) | --- | | 26 | 0.62 | 14 | | | |
| | | 2.25 | 50.46 | 25 | 0.56 | 18 | | | |
| **JBT0355** | Ac-KKVWQTHPRYFWTMWPDIKGEVIVLFGTKK-NH2 (SEQ ID NO: 3089) | --- | | 12 | --- | 14 | | | |
| **JBT0356** | Ac-KKWQTHPRYFWTMWPDIKGEVIVLFGTKK-NH2 (SEQ ID NO: 3090) | --- | | 11 | no fit | 11 | | | |
| **JBT0357** | Ac-KKGVWQTHPRYFWTMWPDIKGEVIVLFGKK-NH2 (SEQ ID NO: 3035) | --- | | 30 | --- | 25 | | | |
| | | 2.51 | 55.65 | 26 | 0.58 | 20 | | | |
| **JBT0358** | Ac-KKGVWQTHPRYFWTMWPDIKGEVIVLFKK-NH2 (SEQ ID NO: 3046) | --- | | 19 | --- | 27 | | | |
| | | 3.26 | 41.21 | 15 | 0.46 | 16 | | | |

FIGURE 16A

| **JBT-0120** | | **Progress Curves of Inhibition of FXa** | | | **Extrinsic Tenase Inhibition by TFPI** | | **Factor IIa Generation** | | |
|---|---|---|---|---|---|---|---|---|---|
| **PEPTIDE** | **SEQUENCE** | $EC_{50}$ (μM) | % Inhibit (Max) | % Inhibit (2.5μM) | $EC_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| **JBT0120** | Ac-SGASRYKWF[CGMRDMKGTMSC]VWVKFRYDTS-NH2 (SEQ ID NO: 1047) | --- | | NA | 0.94 | 35 | 298 | 374 | 162 |
| | | 0.90 | 85.30 | 58 | 1.84 | 31 | | | |
| | | 1.50 | 88.65 | 48 | | | | | |
| **JBT0120** | Ac-SGASRYKWF[CGMRDMKGTMSC]VWVKFRYDTS-NH2 (SEQ ID NO: 1047) | 1.50 | 74.75 | 43 | 0.86 | 45 | 355 | | |
| | | | | | | | 258 | | |
| | | 1.29 | 69.17 | 43 | 0.88 | 45 | | | |
| **JBT0120** | Ac-SGASRYKWF[CGMRDMKGTMSC]VWVKFRYDTS-NH2 (SEQ ID NO: 1047) | 1.18 | 50.68 | 34 | 1.18 | 46 | 326 | 288 | |
| | | --- | | 37 | --- | 48 | 383 | | |
| | | --- | | 38 | | | 299 | | |
| | | 1.26 | 46.06 | 32 | 0.38 | 40 | | | |
| **JBT0120** | Ac-SGASRYKWF[CGMRDMKGTMSC]VWVKFRYDTS-NH2***HCL** (SEQ ID NO: 1047) | 2.64 | 93.62 | 43 | 0.98 | 43 | | | |
| **JBT0124** | Biotin-Ttds-SGASRYKWFCGMRDMKGTMSCVWVKFRYDTS-NH2 (SEQ ID NO: 1290) | 1.59 | 73.59 | 41 | 1.26 | 36 | | | |
| **JBT0247** | Ac- | --- | | 43 | --- | 44 | 273 | | |

FIGURE 16B

| | | | | | | | | | |
|---|---|---|---|---|---|---|---|---|---|
| | SGASRYKWFCGMRDMKGTMSCVWVKFRYDTS-NH2 (SEQ ID NO: 1213) | | | | | | | | |
| | | 0.79 | 50.9 | 42 | 0.61 | 42 | | | |
| **JBT0248** | Ac-KKSGASRYKWF[CGMRDMKGTMSC]VWVKFRYDTSKK-NH2 cyc. (SEQ ID NO: 1001) | --- | | 54 | --- | 60 | 164 | | |
| | | 0.82 | 76.13 | 53 | 0.27 | 52 | | | |
| **JBT0249** | Ac-KKSGASRYKWFCGMRDMKGTMSKK-NH2 (SEQ ID NO: 1214) | --- | | 0 | --- | 3 | inhib | | |
| | | | | | --- | 17 | | | |
| | | | | | 1.06 | 16 | | | |
| **JBT0250** | Ac-KKSRYKWFCGMRDMKGTMSCVWKK-NH2 (SEQ ID NO: 1201) | --- | | 0 | | 15 | inhib | | |
| | | --- | | 11 | --- | 20 | inhib | | |
| | | | | | 0.61 | 19 | | | |
| | | | | | --- | 17 | | | |
| **JBT0251** | Ac-KKKWFCGMRDMKGTMSCVWVKFKK-NH2 (SEQ ID NO: 1202) | --- | | 17 | 0.63 | 23 | inhib | | |
| | | 0.66 | 24.03 | 16 | | | inhib | | |
| | | --- | | 11 | --- | 18 | | | |
| **JBT0252** | Ac-KKCGMRDMKGTMSCVWVKFRYDKK-NH2 (SEQ ID NO: 1215) | --- | | 13 | 1.02 | 18 | inhib | | |
| | | 6.27 | 37.09 | 11 | | | | | |
| **JBT0253** | Ac-KKMRDMKGTMSCVWVKFRYDTSKK-NH2 (SEQ ID NO: 1216) | --- | | 0 | --- | 15 | inhib | | |
| | | | | | --- | 23 | | | |
| | | | | | 0.55 | 23 | | | |
| **JBT0319** | Ac-SGASRYKWFCGMRDMKGTMSCVWVKFRY-NH2, cyc (SEQ ID NO: 1002) | 0.51 | 71.07 | 59 | --- | 56 | 383 | 293 | |
| | | | | | | | 294 | | |
| **JBT0319** | Ac-SGASRYKWFCGMRDMKGTMSCVWVKFRY- | 0.30 | 82.38 | 72 | --- | 60 | 466 | | |

FIGURE 16C

| | | | | | | | | | |
|---|---|---|---|---|---|---|---|---|---|
| | NH2, cyc (SEQ ID NO: 1002) | | | | | | | | |
| **JBT0320** | Ac-SGASRYKWF[CGMRDMKGTMSC]VWVK-NH2 (SEQ ID NO: 1103) | 18.80 | 73.34 | 9 | 6.40 | 7 | 153 | | |
| **JBT0321** | Ac-SGASRYKWFCGMRDMKGTMSCV-NH2 (SEQ ID NO: 1217) | --- | | 0 | --- | 1 | -- | | |
| **JBT0322** | Ac-SGASRYKWFCGMRDMKGTM-NH2 (SEQ ID NO: 1218) | --- | | 0 | --- | 5 | -- | | |
| **JBT0322** | Ac-SGASRYKWFCGMRDMKGTM-NH2 (SEQ ID NO: 1218) | --- | | 0 | --- | 3 | -- | | |
| **JBT0323** | Ac-SRYKWF[CGMRDMKGTMSC]VWVKFRYDTS-NH2 (SEQ ID NO: 1076) | 0.72 | 51.55 | 42 | 0.77 | 48 | 355 | 314 | |
| | | | | | | | 285 | | |
| **JBT0324** | Ac-KWFCGMRDMKGTMSCVWVKFRYDTS-NH2 (SEQ ID NO: 1155) | --- | | 0 | 2.44 | 18 | 91 | | |
| **JBT0325** | Ac-[CGMRDMKGTMSC]VWVKFRYDTS-NH2 (SEQ ID NO: 1219) | --- | | 0 | --- | 4 | -- | | |
| **JBT0326** | Ac-RDMKGTMSCVWVKFRYDTS-NH2 (SEQ ID NO: 1220) | --- | | 0 | --- | 3 | -- | | |
| **JBT0326** | Ac-RDMKGTMSCVWVKFRYDTS-NH2 (SEQ ID NO: 1220) | | | | | | -- | | |
| **JBT0327** | Ac-SGASRYKWFCGMRDMKGTMS-NH2 (SEQ ID NO: 1222) | --- | | 0 | --- | 0 | -- | | |
| **JBT0328** | Ac-SRYKWFCGMRDMKGTMSCVW-NH2 (SEQ ID NO: 1223) | --- | | 0 | --- | 1 | -- | | |
| **JBT0329** | Ac-KWF[CGMRDMKGTMSC]VWVKF-NH2 (SEQ ID NO: 1156) | --- | | 2 | --- | 8 | 70 | 66 | |
| | | --- | | 4 | --- | 13 | 40 | | |
| | | no fit | | 7 | 3.53 | 6 | 84 | | |
| **JBT0330** | Ac-CGMRDMKGTMSCVWVKFRYD-NH2 (SEQ ID NO: 1224) | --- | | 0 | --- | 9 | -- | | |
| **JBT0330** | Ac-[CGMRDMKGTMSC]VWVKFRYD-NH2 (SEQ ID NO: 1224) | --- | | 0 | --- | 7 | | | |
| **JBT0331** | Ac-MRDMKGTMSCVWVKFRYDTS-NH2 (SEQ | --- | | 0 | --- | 5 | -- | | |

FIGURE 16D

| | | | | | | | | | |
|---|---|---|---|---|---|---|---|---|---|
| | ID NO: 1225) | | | | | | | | |
| **JBT0331** | Ac-MRDMKGTMSCVWVKFRYDTS-NH2 (SEQ ID NO: 1225) | --- | | 0 | --- | 5 | -- | | |
| **JBT0332** | Ac-SRYKWFCGMRDMKGTMSCVW-NH2 (SEQ ID NO: 1206) | --- | | 1 | --- | 5 | -- | | |
| **JBT0333** | Ac-KWFCGMRDMKGTMSCVWVKF-NH2 (SEQ ID NO: 1207) | --- | | 3 | --- | 12 | 40 | -- | |
| | | | | | | | -- | | |
| **JBT0333** | Ac-KWFCGMRDMKGTMSCVWVKF-NH2 (SEQ ID NO: 1207) | --- | | 4 | --- | 11 | 114 | | |
| **JBT0334** | Ac-CGMRDMKGTMSCVWVKFRYD-NH2 (SEQ ID NO: 1227) | --- | | 0 | --- | 3 | -- | | |
| **JBT0409** | Ac-SGASRYKWFSGMRDMKGTMSSVWVKFRYDTS-NH2 (SEQ ID NO: 1204) | --- | | 0 | --- | 5 | inhib | | |
| **JBT0410** | Ac-SGASRYKWFSG-Nle-RD-Nle-KGT-Nle-SSVWVKFRYDTS-NH2 (SEQ ID NO: 1208) | --- | | 0 | --- | 7 | inhib | | |
| **JBT0411** | Ac-SGASRYKWF[CG-Nle-RD-Nle-KGT-Nle-SC]VWVKFRYDTS-NH2 (SEQ ID NO: 1104) | --- | | 11 | --- | 24 | 97 | | |
| **JBT0412** | Ac-KWF[CG-Nle-RD-Nle-KGT-Nle-SC]VWVKF-NH2 (SEQ ID NO: 1209) | --- | | 7 | --- | 12 | 46 | | |
| **JBT0413** | Ac-KWFSGMRDMKGTMSSVWVKF-NH2 (SEQ ID NO: 1228) | --- | | 0 | --- | 2 | inhib | | |
| **JBT0414** | Ac-KWFSG-Nle-RD-Nle-KGT-Nle-SSVWVKF-NH2 (SEQ ID NO: 1205) | --- | | 4 | --- | 8 | inhib | | |
| **JBT0415** | Ac-SRYKWF[CGMRDMKGTMSC]VWVKF-NH2 (SEQ ID NO: 1003) | --- | | 59 | --- | 43 | 359 | | |
| | | --- | | 66 | | | | | |
| | | 0.38 | 74.56 | 61 | 0.19 | 52 | | | |
| **JBT0416** | Ac-SRYKWF[CG-Nle-RD-Nle-KGT-Nle-SC]VWVKF-NH2 (SEQ ID NO: 1077) | --- | | 52 | --- | 46 | 256 | | |
| **JBT0417** | Ac-SRYKWFSGMRDMKGTMSSVWVKF-NH2 (SEQ ID NO: 1229) | --- | | 2 | --- | 11 | inhib | | |
| | | no fit | | 0 | no fit | 6 | | | |

FIGURE 16E

| | | | | | | | | | |
|---|---|---|---|---|---|---|---|---|---|
| **JBT0418** | Ac-SRYKWFSG-Nle-RD-Nle-KGT-Nle-SSVWVKF-NH2 (SEQ ID NO: 1210) | --- | | 4 | --- | 11 | inhib | | |
| **JBT0435*** | Ac-RKRDVSGKM[CWSGFGSKWFRC]ADMMTYYSVT-NH2 (SEQ ID NO: 1211) | --- | | 0 | --- | 5 | | | |
| **JBT0436*** | Ac-RWSGKSTYS[CDAMVRRMGMKC]FSFGWTDVYK-NH2 (SEQ ID NO: 1212) | --- | | 0 | --- | 0 | | | |

FIGURE 17A

| JBT-0121 | | Progress Curves of Inhibition of FXa | | | Extrinsic Tenase Inhibition by TFPI | | Factor IIa Generation | | |
|---|---|---|---|---|---|---|---|---|---|
| **PEPTIDE** | **SEQUENCE** | $EC_{50}$ (μM) | % Inhibit (Max) | % Inhibit (2.5μM) | $EC_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| **JBT0121** | Ac-SGGRKHKHFLRSNGKPSRALCSMHFWRWSTS-NH2 (SEQ ID NO: 3091) | --- | | NA | --- | 15 | 22 | 37 | 25 |
| | | 0.08 | 14.44 | 14 | 0.17 | 11 | inhib | | |
| | | --- | | 8 | --- | 19 | | | |
| **JBT0125** | Biotin-Ttds-SGGRKHLHFLRSNGKPSRALCSMHFWRWSTS-NH2 (SEQ ID NO: 3092) | 0.10 | 17.22 | 15 | 0.45 | 9 | | | |
| **JBT0419** | Ac-SGGRKHKHFLRSNGKPSRALSSMHFWRWSTS-NH2 (SEQ ID NO: 3093) | --- | | 6 | --- | 7 | | | |
| **JBT0420*** | Ac-KGSSRSGHNALKTHSWMSPFRRRGSWSLHFK-NH2 (SEQ ID NO: 3094) | --- | | 3 | --- | 10 | inhib | | |
| **JBT0421*** | Ac-KSRSGFWHAWSHRTRPMKSRLHLGKFSNSSG-NH2 (SEQ ID NO: 3095) | --- | | 3 | --- | 5 | | | |
| **JBT0422** | Ac-SGGRKHKHFLRSNGKPSRALSSMHFWRW-NH2 (SEQ ID NO: 3096) | --- | | 4 | --- | 11 | inhib | | |
| **JBT0423** | Ac-SGGRKHKHFLRSNGKPSRALSSMHF-NH2 (SEQ ID NO: 3097) | --- | | 2 | --- | 1 | inhib | | |
| **JBT0424** | Ac-SGGRKHKHFLRSNGKPSRALSS-NH2 (SEQ | --- | | 1 | --- | 0 | -- | | |

FIGURE 17B

| | | | | | | | | | |
|---|---|---|---|---|---|---|---|---|---|
| | ID NO: 3098) | | | | | | | | |
| **JBT0425** | Ac-SGGRKHKHFLRSNGKPSRA-NH2 (SEQ ID NO: 3099) | --- | | 3 | --- | 0 | | | |
| **JBT0426** | Ac-RKHKHFLRSNGKPSRALSSMHFWRWSTS-NH2 (SEQ ID NO: 3100) | --- | | 2 | --- | 8 | inhib | | |
| **JBT0427** | Ac-KHFLRSNGKPSRALSSMHFWRWSTS-NH2 (SEQ ID NO: 3101) | --- | | 0 | --- | 0 | | | |
| **JBT0428** | Ac-LRSNGKPSRALSSMHFWRWSTS-NH2 (SEQ ID NO: 3102) | --- | | 2 | --- | 1 | -- | | |
| **JBT0429** | Ac-NGKPSRALSSMHFWRWSTS-NH2 (SEQ ID NO: 3103) | --- | | 0 | --- | 0 | | | |
| **JBT0430** | Ac-SGGRKHKHFLRSNGKPSRAL-NH2 (SEQ ID NO: 3104) | --- | | 0 | --- | 0 | | | |
| **JBT0431** | Ac-RKHKHFLRSNGKPSRALSSM-NH2 (SEQ ID NO: 3105) | --- | | 2 | --- | 8 | | | |
| **JBT0432** | Ac-KHFLRSNGKPSRALSSMHFW-NH2 (SEQ ID NO: 3106) | --- | | 3 | --- | 1 | -- | | |
| **JBT0433** | Ac-LRSNGKPSRALSSMHFWRWS-NH2 (SEQ ID NO: 3107) | --- | | 0 | --- | 1 | -- | | |
| **JBT0434** | Ac-SNGKPSRALSSMHFWRWSTS-NH2 (SEQ ID NO: 3108) | --- | | 0 | --- | 0 | | | |

FIGURE 18A

| JBT-0122 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | $EC_{50}$ (μM) | % Inhibit (Max) | % Inhibit (2.5μM) | $EC_{50}$ (μM) | % Inhibit (2.5μM ) | Induced FVIII Deficiency FEIBA EA (mU/mL) Conc: 10μM | FVIII Deficien t (mU/mL ) Conc: 10μM | FIX Deficient (mU/mL) Conc: 10μM |
| **JBT0122** | AC-SGYASFPLAVQLHVSKRSKEMALARLYYKTS-NH2 (SEQ ID NO: 2002) | --- | | NA | 12.7 | 5 | 115 | 139 | 60 |
| | | 15.5 | 93.8 | 15 | 39.5 | 8 | 175 | | |
| | | 7.92 | 78.52 | 23 | | | 183 | 160 | |
| | | --- | | 9 | --- | 9 | 210 | | |
| | | --- | | 11 | | | | | |
| **JBT0122** | Ac-SGYASFPLAVQLHVSKRSKEMALARLYYKTS-NH2*HCL (SEQ ID NO: 2002) | 15.81 | 64.12 | 6 | 6.70 | 7 | | | |
| **JBT0126** | Biotin-Ttds-SGYASFPLAVQLHVSKRSKEMALARLYYKTS-NH2 (SEQ ID NO: 2498) | --- | | NA | 5.05 | 5 | | | |
| | | 14.1 | 88.4 | 17 | | | | | |
| **JBT0221** | Ac-KKSGYASFPLAVQLHVSKRSKEMALARLYYKTSKK-NH2 (SEQ ID NO: 2003) | --- | | 10 | 3.37 | 19 | 218 | | |
| | | --- | | 29 | | | | | |
| **JBT0222*** | Ac-MKSRSLGLAYFAKHSSLEVLQTRKVAAPYY-NH2 (SEQ ID NO: 2127) | --- | | 0 | --- | 4 | -- | | |

FIGURE 18B

| | | | | | | | | | |
|---|---|---|---|---|---|---|---|---|---|
| | | | | | --- | 5 | | | |
| **JBT0223*** | Ac-KMQLRVYASTAHSRYLLGSSLFPKYAEVKA-NH2 (SEQ ID NO: 2297) | --- | | 0 | --- | 4 | -- | | |
| | | | | | --- | 1 | | | |
| | | | | | --- | 3 | | | |
| **JBT0224** | Ac-KKSGYASFPLAVQLHVSKRSKEMALARLYYKK-NH2 (SEQ ID NO: 2298) | --- | | 14 | 3.49 | 18 | 191 | | |
| | | --- | | 26 | | | 203 | 162 | |
| **JBT0225** | Ac-KKSGYASFPLAVQLHVSKRSKEMALARKK-NH2 (SEQ ID NO: 2128) | --- | | 9 | --- | 0 | 55 | | |
| | | --- | | 12 | | | | | |
| **JBT0226** | Ac-KKSGYASFPLAVQLHVSKRSKEMAKK-NH2 (SEQ ID NO: 2299) | --- | | 4 | --- | 0 | | | |
| | | --- | | 6 | | | | | |
| **JBT0227** | Ac-KKSGYASFPLAVQLHVSKRSKKK-NH2 (SEQ ID NO: 2300) | --- | | 0 | --- | 5 | | | |
| **JBT0228** | Ac-KKASFPLAVQLHVSKRSKEMALARLYYKTSKK-NH2 (SEQ ID NO: 2016) | --- | | 4 | 6.93 | 9 | | | |
| | | --- | | 21 | | | | | |
| **JBT0229** | Ac-KKPLAVQLHVSKRSKEMALARLYYKTSKK-NH2 (SEQ ID NO: 2129) | --- | | 0 | --- | 0 | | | |
| **JBT0230** | Ac-KKVQLHVSKRSKEMALARLYYKTSKK-NH2 (SEQ ID NO: 2301) | --- | | 0 | --- | 0 | | | |
| | | | | | --- | 0 | | | |
| **JBT0231** | Ac-KKHVSKRSKEMALARLYYKTSKK-NH2 (SEQ ID NO: 2302) | --- | | 0 | --- | 0 | | | |
| **JBT0232** | Ac-KKGYASFPLAVQLHVSKRSKEMKK-NH2 (SEQ ID NO: 2303) | --- | | 4 | --- | 2 | | | |

FIGURE 18C

| | | 13.25 | 38.12 | 6 | | | | | |
|---|---|---|---|---|---|---|---|---|---|
| **JBT0233** | Ac-KKYASFPLAVQLHVSKRSKEMAKK-NH2 (SEQ ID NO: 2304) | --- | | 6 | --- | 6 | | | |
| | | --- | | 8 | | | | | |
| **JBT0234** | Ac-KKVQLHVSKRSKEMALARLYYKKK-NH2 (SEQ ID NO: 2305) | --- | | 0 | --- | 3 | | | |
| **JBT0235** | Ac-KKQLHVSKRSKEMALARLYYKTKK-NH2 (SEQ ID NO: 2306) | --- | | 0 | --- | 0 | | | |
| | | | | | --- | 0 | | | |
| **JBT0236** | Ac-KKLHVSKRSKEMALARLYYKTSKK-NH2 (SEQ ID NO: 2307) | --- | | 0 | --- | 0 | | | |
| **JBT0237** | Ac-KKSGYASFPLAVQLHVSKRSKEKK-NH2 (SEQ ID NO: 2308) | --- | | 0 | --- | 2 | | | |
| **JBT0359** | Ac-ASFPLAVQLHVSKRSKEMA-NH2 (SEQ ID NO: 2309) | --- | | 0 | --- | 6 | --- | | |
| **JBT0360** | Ac-SFPLAVQLHVSKRSKEMA-NH2 (SEQ ID NO: 2310) | --- | | 1 | --- | 2 | --- | | |
| **JBT0361** | Ac-FPLAVQLHVSKRSKEMA-NH2 (SEQ ID NO: 2311) | --- | | 0 | --- | 9 | --- | | |
| **JBT0362** | Ac-ASFPLAVQLHVSKRSKEM-NH2 (SEQ ID NO: 2312) | --- | | 0 | --- | 6 | --- | | |
| **JBT0363** | Ac-ASFPLAVQLHVSKRSKE-NH2 (SEQ ID NO: 2313) | --- | | 0 | --- | 9 | --- | | |
| **JBT0364** | Ac-ASFPLAVQLHVSKRSKEMAL-NH2 (SEQ ID NO: 2314) | --- | | 2 | --- | 12 | --- | | |
| **JBT0365** | Ac-ASFPLAVQLHVSKRSKEMALA-NH2 (SEQ ID NO: 2315) | --- | | 0 | --- | 9 | --- | | |
| **JBT0366** | Ac-ASFPLAVQLHVSKRSKEMALAR-NH2 (SEQ ID NO: 2316) | --- | | 0 | --- | 11 | --- | | |
| **JBT0367** | Ac-ASFPLAVQLHVSKRSKEMALARL-NH2 (SEQ ID NO: 2317) | --- | | 2 | --- | 10 | 28 | | |
| **JBT0368** | Ac-ASFPLAVQLHVSKRSKEMALARLY-NH2 (SEQ ID NO: 2130) | --- | | 0 | --- | 8 | 36 | | |
| **JBT0369** | Ac-ASFPLAVQLHVSKRSKEMALARLYY-NH2 | --- | | 2 | --- | 9 | 68 | | |

FIGURE 18D

| | | | | | | | | | |
|---|---|---|---|---|---|---|---|---|---|
| | (SEQ ID NO: 2017) | | | | | | | | |
| **JBT0370** | Ac-YASFPLAVQLHVSKRSKEMA-NH2 (SEQ ID NO: 2318) | --- | | 2 | --- | 0 | 39 | | |
| **JBT0371** | Ac-GYASFPLAVQLHVSKRSKEMA-NH2 (SEQ ID NO: 2319) | --- | | 8 | --- | 1 | 60 | | |

FIGURE 19A

| JBT0047 class | | BiaCore | | |
|---|---|---|---|---|
| | | | | |
| | | | | |
| **Peptide** | **Sequence** | **$k_{on}$ (1/Ms)** | **$k_{off}$ (1/s)** | **$K_D$ (M)** |
| **JBT0047** | Ac-SGVGRLQVAFQSKKNVFVFGYFERLRAKLTS-NH2 (SEQ ID NO: 253) | 3.98E+05 | 1.88E-02 | 4.72E-08 |
| **JBT0131** | Biotin-Ttds-AFQSKKNVFVFGYFERLRAK-NH2 (SEQ ID NO: 964) | 1.38E+05 | 5.94E-02 | 4.31E-07 |
| **JBT0132** | Biotin-Ttds-FQSKKNVFVFGYFERLRAKL-NH2 (SEQ ID NO: 965) | 3.55E+04 | 3.26E-02 | 9.17E-07 |
| **JBT0155** | Ac-KKSGVGRLQVAFQSKKNVFVFGYFERLRAKLTSKK-NH2 (SEQ ID NO: 8) | 1.64E+05 | 7.25E-03 | 4.41E-08 |
| **JBT0158** | Ac-KKSGVGRLQVAFQSKKNVFVFGYFERLRAKKK-NH2 (SEQ ID NO: 9) | 4.49E+05 | 3.27E-02 | 7.29E-08 |
| **JBT0164** | Ac-KKFQSKKNVFVFGYFERLRAKLTSKK-NH2 (SEQ ID NO: 12) | 2.26E+05 | 1.05E-02 | 4.65E-08 |
| **JBT0170** | Ac-KKFQSKKNVFVFGYFERLRAKLKK-NH2 (SEQ ID NO: 13) | 4.09E+05 | 9.34E-03 | 2.28E-08 |
| **JBT0175** | Ac-KKAFQSKKNVFVFGYFERLRAKLTKK-NH2 (SEQ ID NO: 182) | 2.70E+05 | 1.67E-02 | 6.18E-08 |
| **JBT0293** | Ac-FQSKKNVFVFGYFERLRAKL-NH2 (SEQ ID NO: 256) | 2.17E+05 | 2.12E-02 | 9.74E-08 |
| **JBT0294** | Ac-YQSKKNVFVFGYFERLRAKL-NH2 (SEQ ID NO: 257) | 5.69E+05 | 3.92E-02 | 6.90E-08 |
| **JBT0297** | Ac-FQSKNNVFVFGYFERLRAKL-NH2 (SEQ ID NO: 183) | 5.69E+05 | 3.92E-02 | 6.90E-08 |
| **JBT0302** | Ac-FQSKKNVFVAGYFERLRAKL-NH2 (SEQ ID NO: 258) | 1.02E+06 | 8.47E-02 | 8.27E-08 |
| **JBT0303** | Ac-FQSKKNVFVDGYFERLRAKL-NH2 (SEQ ID NO: 184) | 8.13E+05 | 2.75E-02 | 3.38E-08 |
| **JBT0305** | Ac-FQSKKNVFVQGYFERLRAKL-NH2 (SEQ ID NO: 260) | 7.45E+05 | 3.07E-02 | 4.11E-08 |
| **JBT0306** | Ac-FQSKKNVFVSGYFERLRAKL-NH2 (SEQ ID NO: 185) | 6.56E+05 | 3.61E-02 | 5.50E-08 |
| **JBT0307** | Ac-FQSKKNVFVYGYFERLRAKL-NH2 (SEQ ID NO: 261) | 5.95E+05 | 3.15E-02 | 5.30E-08 |
| **JBT0310** | Ac-FQSKKNVFVFGYFDRLRAKL-NH2 (SEQ ID NO: 262) | 5.62E+04 | 1.05E-02 | 1.87E-07 |
| **JBT0337** | Ac-FQSKNNVFVDGYFDRLRAKL-NH2 (SEQ ID NO: 16) | 2.90E+05 | 5.30E-03 | 1.83E-08 |
| **JBT0342** | Ac-FQSKNNVFVDGYFERLRAKL-NH2 (SEQ ID NO: 19) | 3.92E+05 | 6.55E-03 | 1.67E-08 |
| **JBT0343** | Ac-FQSKKNVFVDGYFDRLRAKL-NH2 (SEQ ID NO: 188) | 3.28E+05 | 1.46E-02 | 4.46E-08 |
| **JBT0375** | Ac-FQSKGNVFVFGYFERLRAKL-NH2 (SEQ ID NO: 190) | 4.00E+05 | 1.21E-02 | 3.04E-08 |
| **JBT0471** | Ac-FQSKGNVFVTGYFERLRAKL-NH2 (SEQ ID NO: 26) | 7.03E+05 | 9.34E-03 | 1.33E-08 |
| **JBT0474** | Ac-FQSKGNVFVKGYFERLRAKL-NH2 (SEQ ID NO: 29) | 9.95E+05 | 1.49E-02 | 1.50E-08 |

FIGURE 19B

| | | | | |
|---|---|---|---|---|
| **JBT0477** | Ac-FQSKGNVFVDGYFERLRAKL-NH2 (SEQ ID NO: 32) | 3.72E+05 | 3.02E-03 | 8.10E-09 |
| **JBT0500** | Ac-FQSK-NmetGly-NVFVFGYFERLRAKL-NH2 (SEQ ID NO: 46) | 2.52E+05 | 2.06E-03 | 8.19E-09 |
| **JBT0683** | Ac-FQSK-Nmg-AVFVDGYFARLRAKL-NH2 (SEQ ID NO: 55) | 1.00E+06 | 1.07E-03 | 1.07E-09 |
| **JBT0765** | Ac-FQSKGNVFVDGYFERL-Eew-AKL-NH2 (SEQ ID NO: 68) | 2.31E+05 | 1.85E-03 | 8.00E-09 |
| **JBT0789** | Ac-FQSK-Nmg-NVFVDGYFERL-Nle-AKL-NH2 (SEQ ID NO: 71) | 1.92E+05 | 4.06E-04 | 2.12E-09 |
| **JBT1122** | Ac-FQSK-Nmg-NVFVDGYFARL-Nle-AKL-NH2 (SEQ ID NO: 113) | 6.99E+04 | 9.61E-04 | 1.38E-08 |
| **JBT1141** | Ac-FQSKkAVFVKGYFARLRAKL-NH2 (SEQ ID NO: 120) | 1.36E+05 | 3.16E-03 | 2.33E-08 |
| **JBT1144** | Ac-FQSKdAVFVKGYFARLRAKL-NH2 (SEQ ID NO: 121) | 3.05E+05 | 1.00E-02 | 3.28E-08 |

FIGURE 20

| JBT0120 class | | BiaCore | | |
|---|---|---|---|---|
| | | | | |
| | | | | |
| **Peptide** | **Sequence** | **$k_{on}$ (1/Ms)** | **$k_{off}$ (1/s)** | **$K_D$ (M)** |
| **JBT0120** | Ac-SGASRYKWF[CGMRDMKGTMSC]VWVKFRYDTS-NH2 (SEQ ID NO: 1047) | 1.17E+06 | 4.78E-02 | 4.08E-08 |
| **JBT0320** | Ac-SGASRYKWF[CGMRDMKGTMSC]VWVK-NH2 (SEQ ID NO: 1103) | 1.78E+05 | 4.25E-02 | 2.38E-07 |
| **JBT0324** | Ac-KWFCGMRDMKGTMSCVWVKFRYDTS-NH2 (SEQ ID NO: 1155) | 1.54E+04 | 6.36E-03 | 4.14E-07 |
| **JBT0415** | Ac-SRYKWF[CGMRDMKGTMSC]VWVKF-NH2 (SEQ ID NO: 1003) | 1.75E+05 | 2.24E-02 | 1.28E-07 |
| **JBT0444** | Ac-SRYKWF[CAMRDMKGTMSC]VWVKF-NH2 (SEQ ID NO: 1004) | 4.18E+05 | 1.21E-02 | 2.90E-08 |
| **JBT0447** | Ac-SRYKWF[CGMRAMKGTMSC]VWVKF-NH2 (SEQ ID NO: 1158) | 6.86E+03 | 5.60E-03 | 8.16E-07 |
| **JBT0455** | Ac-SRYKWF[CGMRDMKGTMSC]AWVKF-NH2 (SEQ ID NO: 1049) | 4.77E+05 | 3.03E-02 | 6.35E-08 |
| **JBT0643** | Ac-SRYKWF[CGMPDMKGTMSC]VWVKF-NH2 (SEQ ID NO: 1006) | 1.78E+05 | 3.22E-02 | 1.81E-07 |

FIGURE 21

| **JBT0122 class** | | **BiaCore** | | |
|---|---|---|---|---|
| | | | | |
| | | | | |
| **Peptide** | **Sequence** | **$k_{on}$ (1/Ms)** | **$k_{off}$ (1/s)** | **$K_D$ (M)** |
| **JBT0122** | AC-SGYASFPLAVQLHVSKRSKEMALARLYYKTS-NH2 (SEQ ID NO: 2002) | 1.13E+04 | 2.23E-02 | 1.97E-06 |
| **JBT0221** | Ac-KKSGYASFPLAVQLHVSKRSKEMALARLYYKTSKK-NH2 (SEQ ID NO: 2003) | 6.31E+04 | 1.19E-02 | 1.88E-07 |
| **JBT0224** | Ac-KKSGYASFPLAVQLHVSKRSKEMALARLYYKK-NH2 (SEQ ID NO: 2298) | 6.39E+04 | 1.95E-02 | 3.05E-07 |

FIGURE 22A

| **JBT0047 class** | | **FXa Inhibition assay** | | | |
|---|---|---|---|---|---|
| | | | | | |
| **Peptide** | **Sequence** | **EC50 (µM)** | **Maximal inhibition (%)** | **% Inhibition @ 2.5µM** | **% Inhibition @ 0.63µM** |
| **JBT0047** | Ac-SGVGRLQVAFQSKKNVFVFGYFERLRAKLTS-NH2 (SEQ ID NO: 253) | 0.72 | | 68 | |
| **JBT0051** | Biotin-Ttds-SGVGRLQVAFQSKKNVFVFGYFERLRAKLTS-NH2 (SEQ ID NO: 962) | 0.53 | | 66 | |
| **JBT0055** | Ac-SGVGRLQVAFQSKKNVFVFGYFERLRAKLTS-Ttds-Lysin(biotin)-NH2 (SEQ ID NO: 963) | 0.53 | | 72 | |
| **JBT0131** | Biotin-Ttds-AFQSKKNVFVFGYFERLRAK-NH2 (SEQ ID NO: 964) | 8.20 | | 23 | |
| **JBT0132** | Biotin-Ttds-FQSKKNVFVFGYFERLRAKL-NH2 (SEQ ID NO: 965) | 1.15 | | 36 | |
| **JBT0133** | Biotin-Ttds-QSKKNVFVFGYFERLRAKLT-NH2 (SEQ ID NO: 966) | | | 15 | |
| **JBT0134** | Biotin-Ttds-QSKKNVFVFGYFERLRAK-NH2 (SEQ ID NO: 967) | | | 5 | |
| **JBT0155** | Ac-KKSGVGRLQVAFQSKKNVFVFGYFERLRAKLTSKK-NH2 (SEQ ID NO: 8) | 0.97 | | 54 | |
| **JBT0156*** | Ac-VVEKLTFVQLSFLNRRRFSQYAGFKGAGKV-NH2 (SEQ ID NO: 742) | | | 0 | |
| **JBT0157*** | Ac-RVFLYFSGKAGGLVKLVERQAFQTNVSKFR-NH2 (SEQ ID NO: 743) | | | 0 | |
| **JBT0158** | Ac-KKSGVGRLQVAFQSKKNVFVFGYFERLRAKKK-NH2 (SEQ ID NO: 9) | 4.26 | | 35 | |
| **JBT0159** | Ac-KKSGVGRLQVAFQSKKNVFVFGYFERLKK-NH2 (SEQ ID NO: 744) | | | 0 | |
| **JBT0160** | Ac-KKSGVGRLQVAFQSKKNVFVFGYFKK-NH2 (SEQ ID NO: 745) | | | 0 | |
| **JBT0161** | Ac-KKSGVGRLQVAFQSKKNVFVFKK-NH2 (SEQ ID NO: 746) | | | 0 | |
| **JBT0162** | Ac-KKGRLQVAFQSKKNVFVFGYFERLRAKLTSKK-NH2 (SEQ ID NO: 10) | 0.74 | | 54 | |
| **JBT0163** | Ac-KKQVAFQSKKNVFVFGYFERLRAKLTSKK-NH2 (SEQ ID NO: 11) | 1.54 | | 48 | |
| **JBT0164** | Ac-KKFQSKKNVFVFGYFERLRAKLTSKK-NH2 (SEQ ID NO: 12) | 1.74 | | 43 | |
| **JBT0165** | Ac-KKKKNVFVFGYFERLRAKLTSKK-NH2 (SEQ ID NO: 712) | | | 0 | |
| **JBT0166** | Biotinyl-Ttds-KKFQSKKNVFVFGYFERLRAKLKK-NH2 (SEQ ID NO: 968) | 2.60 | | 50 | |
| **JBT0167*** | Biotinyl-Ttds-GKNAKFYLFESLRQVKFVFR-NH2 (SEQ ID NO: 969) | | | 0 | |

FIGURE 22B

| | | | | | |
|---|---|---|---|---|---|
| **JBT0168*** | Biotinyl-Ttds-YKFSFNKELFKQARLRFVGV-NH2 (SEQ ID NO: 970) | | | 0 | |
| **JBT0169** | Ac-KKAFQSKKNVFVFGYFERLRAKKK-NH2 (SEQ ID NO: 254) | | | 16 | |
| **JBT0170** | Ac-KKFQSKKNVFVFGYFERLRAKLKK-NH2 (SEQ ID NO: 13) | | | 61 | |
| **JBT0171** | Ac-KKQSKKNVFVFGYFERLRAKLTKK -NH2 (SEQ ID NO: 255) | | | 25 | |
| **JBT0172** | Ac-KKQSKKNVFVFGYFERLRAKKK-NH2 (SEQ ID NO: 406) | | | 7 | |
| **JBT0173** | Biotinyl-Ttds-SGVGRLQVAFQSKKNVFVFG-NH2 (SEQ ID NO: 971) | | | 0 | |
| **JBT0174** | Ac-KKAFQSKKNVFVFGYFERLRAKLKK-NH2 (SEQ ID NO: 14) | | | 47 | |
| **JBT0175** | Ac-KKAFQSKKNVFVFGYFERLRAKLTKK-NH2 (SEQ ID NO: 182) | 2.71 | | 40 | |
| **JBT0293** | Ac-FQSKKNVFVFGYFERLRAKL-NH2 (SEQ ID NO: 256) | 3.11 | 61 | 26 | 8 |
| **JBT0294** | Ac-YQSKKNVFVFGYFERLRAKL-NH2 (SEQ ID NO: 257) | 4.07 | | 40 | |
| **JBT0295** | Ac-FSSKKNVFVFGYFERLRAKL-NH2 (SEQ ID NO: 713) | | | 2 | |
| **JBT0296** | Ac-FQNKKNVFVFGYFERLRAKL-NH2 (SEQ ID NO: 407) | 4.91 | | 19 | |
| **JBT0297** | Ac-FQSKNNVFVFGYFERLRAKL-NH2 (SEQ ID NO: 183) | 0.63 | | 59 | |
| **JBT0298** | Ac-FQSKQNVFVFGYFERLRAKL-NH2 (SEQ ID NO: 747) | 1.83 | | 42 | |
| **JBT0299** | Ac-FQSKKNVFAFGYFERLRAKL-NH2 (SEQ ID NO: 408) | 15.31 | | 9 | |
| **JBT0300** | Ac-FQSKKNVFSFGYFERLRAKL-NH2 (SEQ ID NO: 409) | | | 7 | |
| **JBT0301** | Ac-FQSKKNVFTFGYFERLRAKL-NH2 (SEQ ID NO: 410) | | | 9 | |
| **JBT0302** | Ac-FQSKKNVFVAGYFERLRAKL-NH2 (SEQ ID NO: 258) | 2.10 | | 47 | |
| **JBT0303** | Ac-FQSKKNVFVDGYFERLRAKL-NH2 (SEQ ID NO: 184) | 0.88 | 69 | 50 | 26 |
| **JBT0304** | Ac-FQSKKNVFVLGYFERLRAKL-NH2 (SEQ ID NO: 259) | 2.95 | | 32 | |
| **JBT0305** | Ac-FQSKKNVFVQGYFERLRAKL-NH2 (SEQ ID NO: 260) | 2.28 | | 45 | |
| **JBT0306** | Ac-FQSKKNVFVSGYFERLRAKL-NH2 (SEQ ID NO: 185) | 3.56 | | 37 | |
| **JBT0307** | Ac-FQSKKNVFVYGYFERLRAKL-NH2 (SEQ ID NO: 261) | 3.42 | | 34 | |
| **JBT0308** | Ac-FQSKKNVFVFGYKERLRAKL-NH2 (SEQ ID NO: 411) | | | 9 | |
| **JBT0309** | Ac-FQSKKNVFVFGYYERLRAKL-NH2 (SEQ ID NO: 412) | 4.50 | | 19 | |
| **JBT0310** | Ac-FQSKKNVFVFGYFDRLRAKL-NH2 (SEQ ID NO: 262) | 3.86 | | 26 | |
| **JBT0311** | Ac-FQSKKNVFVFGYFERLRAKN-NH2 (SEQ ID NO: 748) | | | 5 | |
| **JBT0335** | Ac-FQSKKNVFVFGYFERLRAK-NH2 (SEQ ID NO: 749) | 6.20 | | 2 | |
| **JBT0336** | Ac-FQSKNNVFVAGYFDRLRAKL-OH (SEQ ID NO: 263) | 6.52 | | 19 | |

FIGURE 22C

| | | | | | |
|---|---|---|---|---|---|
| **JBT0337** | Ac-FQSKNNVFVDGYFDRLRAKL-NH2 (SEQ ID NO: 16) | 0.71 | | 51 | |
| **JBT0338** | Ac-FQSKNNVFVQGYFDRLRAKL-NH2 (SEQ ID NO: 17) | 1.12 | | 40 | |
| **JBT0339** | Ac-FQSKNNVFVSGYFDRLRAKL-NH2 (SEQ ID NO: 18) | 1.22 | | 42 | |
| **JBT0340** | Ac-FQSKNNVFVYGYFDRLRAKL-NH2 (SEQ ID NO: 186) | 1.87 | | 37 | |
| **JBT0341** | Ac-FQSKNNVFVFGYFDRLRAKL-NH2 (SEQ ID NO: 187) | 1.08 | | 38 | |
| **JBT0342** | Ac-FQSKNNVFVDGYFERLRAKL-NH2 (SEQ ID NO: 19) | 0.38 | | 58 | |
| **JBT0343** | Ac-FQSKKNVFVDGYFDRLRAKL-NH2 (SEQ ID NO: 188) | 1.08 | | 34 | |
| **JBT0374** | Ac-FQSKDNVFVFGYFERLRAKL-NH2 (SEQ ID NO: 20) | 0.75 | 66 | 52 | 27 |
| **JBT0375** | Ac-FQSKGNVFVFGYFERLRAKL-NH2 (SEQ ID NO: 190) | 0.41 | 73 | 65 | 40 |
| **JBT0376** | Ac-FQSKKNAFVFGYFERLRAKL-NH2 (SEQ ID NO: 414) | | | 11 | |
| **JBT0377** | Ac-FQSKKNQFVFGYFERLRAKL-NH2 (SEQ ID NO: 264) | | | 20 | |
| **JBT0378** | Ac-FQSKKNVFVEGYFERLRAKL-NH2 (SEQ ID NO: 21) | 1.59 | 79 | 44 | |
| **JBT0379** | Ac-FQSKKNVFVTGYFERLRAKL-NH2 (SEQ ID NO: 22) | 3.13 | 81 | 36 | |
| **JBT0380** | Ac-FQSKKNVFVVGYFERLRAKL-NH2 (SEQ ID NO: 191) | 2.59 | 73 | 34 | |
| **JBT0381** | Ac-FQSPKNVFVFGYFERLRAKL-NH2 (SEQ ID NO: 265) | 3.28 | 81 | 34 | |
| **JBT0385** | Ac-FQSKKNNFVFGYFERLRAKL-NH2 (SEQ ID NO: 672) | | | 0 | |
| **JBT0386** | Ac-FQSKKNPFVFGYFERLRAKL-NH2 (SEQ ID NO: 415) | | | 6 | |
| **JBT0388** | Ac-FQSKKNVHVFGYFERLRAKL-NH2 (SEQ ID NO: 192) | 4.34 | 73 | 26 | |
| **JBT0389** | Ac-FQSKKNVVVFGYFERLRAKL-NH2 (SEQ ID NO: 673) | | | 0 | |
| **JBT0390** | Ac-FQSKKNVFQFGYFERLRAKL-NH2 (SEQ ID NO: 674) | | | 0 | |
| **JBT0391** | Ac-FQSKKNVFVGGYFERLRAKL-NH2 (SEQ ID NO: 266) | 7.02 | 74 | 18 | |
| **JBT0392** | Ac-FQSKKNVFVHGYFERLRAKL-NH2 (SEQ ID NO: 23) | 2.48 | 74 | 37 | |
| **JBT0393** | Ac-FQSKKNVFVKGYFERLRAKL-NH2 (SEQ ID NO: 193) | 3.02 | 64 | 28 | |
| **JBT0394** | Ac-FQSKKNVFVMGYFERLRAKL-NH2 (SEQ ID NO: 24) | 6.83 | 57 | 12 | |
| **JBT0395** | Ac-FQSKKNVFVNGYFERLRAKL-NH2 (SEQ ID NO: 25) | 2.80 | 72 | 32 | |
| **JBT0396** | Ac-FQSKKNVFVPGYFERLRAKL-NH2 (SEQ ID NO: 194) | 4.33 | 77 | 30 | |
| **JBT0397** | Ac-FQSKKNVFVRGYFERLRAKL-NH2 (SEQ ID NO: 195) | 5.09 | 72 | 23 | |
| **JBT0398** | Ac-FQSKKNVFVFGYFEELRAKL-NH2 (SEQ ID NO: 196) | | | 4 | |
| **JBT0399** | Ac-FQSKKNVFVFGYFELLRAKL-NH2 (SEQ ID NO: 750) | | | 0 | |

FIGURE 22D

| | | | | | |
|---|---|---|---|---|---|
| **JBT0400** | Ac-FQSKKNVFVFGYFLRLRAKL-NH2 (SEQ ID NO: 267) | | | 1 | |
| **JBT0401** | Ac-FQSKKNVFVFGYFERLRAVL-NH2 (SEQ ID NO: 416) | | | 0 | |
| **JBT0402** | Biotin-Ttds-FQSKNNVFVFGYFERLRAKL-NH2 (SEQ ID NO: 973) | 0.32 | 45 | 48 | |
| **JBT0403** | Biotin-Ttds-FQSKKNVFVDGYFERLRAKL-NH2 (SEQ ID NO: 972) | 0.49 | 64 | 59 | |
| **JBT0404** | Biotin-Ttds-FQSKKNVFVFGYFDRLRAKL-NH2 (SEQ ID NO: 974) | 1.89 | 43 | 24 | |
| **JBT0405** | Biotin-FQSKKNVFVFGYFERLRAKL-NH2 (SEQ ID NO: 975) | 0.86 | 81 | 59 | |
| **JBT0406** | Ac-Ttds-FQSKKNVFVFGYFERLRAKL-NH2 (SEQ ID NO: 268) | | | 28 | |
| **JBT0471** | Ac-FQSKGNVFVTGYFERLRAKL-NH2 (SEQ ID NO: 26) | 0.41 | 77 | 64 | 45 |
| **JBT0472** | Ac-FQSKGNVFVNGYFERLRAKL-NH2 (SEQ ID NO: 27) | 0.37 | 60 | 49 | 34 |
| **JBT0473** | Ac-FQSKGNVFVHGYFERLRAKL-NH2 (SEQ ID NO: 28) | 0.25 | 47 | 45 | 31 |
| **JBT0474** | Ac-FQSKGNVFVKGYFERLRAKL-NH2 (SEQ ID NO: 29) | 0.29 | 75 | 68 | 50 |
| **JBT0475** | Ac-FQSKGNVFVEGYFERLRAKL-NH2 (SEQ ID NO: 30) | 0.25 | 60 | 50 | 37 |
| **JBT0476** | Ac-FQSKGNVFVDGYFDRLRAKL-NH2 (SEQ ID NO: 31) | 0.22 | 54 | 49 | 38 |
| **JBT0477** | Ac-FQSKGNVFVDGYFERLRAKL-NH2 (SEQ ID NO: 32) | 0.23 | 72 | 68 | 51 |
| **JBT0478** | Ac-FQSKDNVFVTGYFERLRAKL-NH2 (SEQ ID NO: 33) | 0.76 | 51 | 39 | 21 |
| **JBT0479** | Ac-FQSKDNVFVNGYFERLRAKL-NH2 (SEQ ID NO: 34) | 1.10 | 58 | 40 | 21 |
| **JBT0480** | Ac-FQSKDNVFVHGYFERLRAKL-NH2 (SEQ ID NO: 35) | 1.11 | 65 | 42 | 24 |
| **JBT0481** | Ac-FQSKDNVFVKGYFERLRAKL-NH2 (SEQ ID NO: 36) | 0.77 | 53 | 41 | 23 |
| **JBT0482** | Ac-FQSKDNVFVEGYFERLRAKL-NH2 (SEQ ID NO: 37) | 0.53 | 86 | 69 | 43 |
| **JBT0483** | Ac-FQSKDNVFVDGYFERLRAKL-NH2 (SEQ ID NO: 38) | 0.53 | 84 | 68 | 41 |
| **JBT0484** | Ac-FQSKDNVFVDGYFDRLRAKL-NH2 (SEQ ID NO: 976) | 0.79 | 73 | 56 | 29 |
| **JBT0485** | Ac-FQSKNNVFVTGYFERLRAKL-NH2 (SEQ ID NO: 39) | 0.75 | 86 | 63 | 38 |
| **JBT0486** | Ac-FQSKNNVFVNGYFERLRAKL-NH2 (SEQ ID NO: 40) | | | 44 | 26 |
| **JBT0487** | Ac-FQSKNNVFVHGYFERLRAKL-NH2 (SEQ ID NO: 41) | | | 58 | 36 |
| **JBT0488** | Ac-FQSKNNVFVKGYFERLRAKL-NH2 (SEQ ID NO: 42) | 0.56 | 78 | 64 | 40 |
| **JBT0489** | Ac-FQSKNNVFVEGYFERLRAKL-NH2 (SEQ ID NO: 43) | 0.42 | 78 | 68 | 48 |
| **JBT0490** | Ac-FQSKQNVFVTGYFERLRAKL-NH2 (SEQ ID NO: 44) | | | 53 | 25 |
| **JBT0491** | Ac-FQSKQNVFVNGYFERLRAKL-NH2 (SEQ ID NO: 197) | | | 53 | 29 |
| **JBT0492** | Ac-FQSKQNVFVHGYFERLRAKL-NH2 (SEQ ID NO: 198) | | | 45 | 24 |

FIGURE 22E

| | | | | | |
|---|---|---|---|---|---|
| **JBT0493** | Ac-FQSKQNVFVKGYFERLRAKL-NH2 (SEQ ID NO: 199) | | | 45 | 21 |
| **JBT0494** | Ac-FQSKQNVFVDGYFERLRAKL-NH2 (SEQ ID NO: 45) | | | 60 | 36 |
| **JBT0495** | Ac-FQSKQNVFVEGYFERLRAKL-NH2 (SEQ ID NO: 200) | | | 59 | 36 |
| **JBT0497** | Ac-NmetPhe-QSKGNVFVFGYFERLRAKL-NH2 (SEQ ID NO: 201) | 0.47 | | 40 | 24 |
| **JBT0498** | Ac-FQ-NmetSer-KGNVFVFGYFERLRAKL-NH2 (SEQ ID NO: 675 | | | 3 | 1 |
| **JBT0499** | Ac-FQS-NmetLys-GNVFVFGYFERLRAKL-NH2 (SEQ ID NO: 202) | 0.83 | 75 | 56 | 30 |
| **JBT0500** | Ac-FQSK-NmetGly-NVFVFGYFERLRAKL-NH2 (SEQ ID NO: 46) | 0.13 | 71 | 70 | 60 |
| **JBT0501** | Ac-FQSKGN-NmetV-FVFGYFERLRAKL-NH2 (SEQ ID NO: 417) | | | 16 | 6 |
| **JBT0502** | Ac-FQSKGNV-NmetPhe-VFGYFERLRAKL-NH2 (SEQ ID NO: 751) | | | 0 | 0 |
| **JBT0503** | Ac-FQSKGNVF-NmetV-FGYFERLRAKL-NH2 (SEQ ID NO: 676) | | | 0 | 0 |
| **JBT0504** | Ac-FQSKGNVFV-NmetPhe-GYFERLRAKL-NH2 (SEQ ID NO: 418) | | | 7 | 2 |
| **JBT0505** | Ac-FQSKGNVFVF-NmetGly-YFERLRAKL-NH2 (SEQ ID NO: 269) | | | 21 | 7 |
| **JBT0506** | Ac-FQSKGNVFVFG-NmetTyr-FERLRAKL-NH2 (SEQ ID NO: 714) | | | 0 | 0 |
| **JBT0507** | Ac-FQSKGNVFVFGY-NmetPhe-ERLRAKL-NH2 (SEQ ID NO: 677) | | | 0 | 0 |
| **JBT0508** | Ac-FQSKGNVFVFGYF-NmetGlu-RLRAKL-NH2 (SEQ ID NO: 678) | | | 0 | 0 |
| **JBT0509** | Ac-FQSKGNVFVFGYFE-Nmr-LRAKL-NH2 (SEQ ID NO: 752) | | | 0 | 0 |
| **JBT0510** | Ac-FQSKGNVFVFGYFER-NmetLeu-RAKL-NH2 (SEQ ID NO: 753) | | | 0 | 0 |
| **JBT0511** | Ac-FQSKGNVFVFGYFERL-Nmr-AKL-NH2 (SEQ ID NO: 754) | | | 0 | 0 |
| **JBT0512** | Ac-FQSKGNVFVFGYFERLR-NmetAla-KL-NH2 (SEQ ID NO: 679) | | | 0 | 0 |
| **JBT0513** | Ac-FQSKGNVFVFGYFERLRA-NmetLys-L-NH2 (SEQ ID NO: 755) | | | 0 | 0 |
| **JBT0514** | Ac-FQSKGNVFVFGYFERLRAK-NmetLeu-NH2 (SEQ ID NO: 419) | | | 1 | 0 |
| **JBT0515** | Ac-bHomoPhe-QSKGNVFVFGYFERLRAKL-NH2 (SEQ ID NO: 420) | | | 22 | 11 |
| **JBT0516** | Ac-F-bHomoGln-SKGNVFVFGYFERLRAKL-NH2 (SEQ ID NO: 680) | | | 7 | 4 |
| **JBT0517** | Ac-FQ-bHomoSer-KGNVFVFGYFERLRAKL-NH2 (SEQ ID NO: 421) | | | 7 | 2 |
| **JBT0518** | Ac-FQS-bHomoLys-GNVFVFGYFERLRAKL-NH2 (SEQ ID NO: 422) | | | 9 | 2 |
| **JBT0519** | Ac-FQSK-bAla-NVFVFGYFERLRAKL-NH2 (SEQ ID NO: 270) | | | 20 | 15 |
| **JBT0520** | Ac-FQSKG-bGln-VFVFGYFERLRAKL-NH2 (SEQ ID NO: 271) | | | 24 | 9 |
| **JBT0521** | Ac-FQSKGN-bLeu-FVFGYFERLRAKL-NH2 (SEQ ID NO: 756) | | | 3 | 3 |
| **JBT0522** | Ac-FQSKGNV-bHomoPhe-VFGYFERLRAKL-NH2 (SEQ ID NO: 681) | | | 5 | 3 |

FIGURE 22F

| | | | | | |
|---|---|---|---|---|---|
| **JBT0523** | Ac-FQSKGNVF-bLeu-FGYFERLRAKL-NH2 (SEQ ID NO: 757) | | | 1 | 2 |
| **JBT0524** | Ac-FQSKGNVFV-bHomoPhe-GYFERLRAKL-NH2 (SEQ ID NO: 682) | | | 0 | 4 |
| **JBT0525** | Ac-FQSKGNVFVF-bAla-YFERLRAKL-NH2 (SEQ ID NO: 758) | | | 0 | 3 |
| **JBT0526** | Ac-FQSKGNVFVFG-bHomoTyr-FERLRAKL-NH2 (SEQ ID NO: 759) | | | 0 | 0 |
| **JBT0527** | Ac-FQSKGNVFVFGY-bHomoPhe-ERLRAKL-NH2 (SEQ ID NO: 683) | | | 9 | 2 |
| **JBT0528** | Ac-FQSKGNVFVFGYF-bE-RLRAKL-NH2 (SEQ ID NO: 272) | | | 25 | 20 |
| **JBT0529** | Ac-FQSKGNVFVFGYFE-bHomoArg-LRAKL-NH2 (SEQ ID NO: 760) | | | 0 | 1 |
| **JBT0530** | Ac-FQSKGNVFVFGYFER-Btl-RAKL-NH2 (SEQ ID NO: 684) | | | 3 | 0 |
| **JBT0532** | Ac-FQSKGNVFVFGYFERLR-bAla-KL-NH2 (SEQ ID NO: 423) | | | 14 | 7 |
| **JBT0533** | Ac-FQSKGNVFVFGYFERLRA-bHomoK-L-NH2 (SEQ ID NO: 424) | | | 17 | 4 |
| **JBT0534** | Ac-FQSKGNVFVFGYFERLRAK-Btl-NH2 (SEQ ID NO: 204) | 0.47 | 48 | 39 | 28 |
| **JBT0535** | Ac-FQSKGNVFVFGYFE-Cit-LRAKL-NH2 (SEQ ID NO: 685) | | | 13 | 5 |
| **JBT0536** | Ac-FQSKGNVFVFGYFERL-Cit-AKL-NH2 (SEQ ID NO: 273) | | | 52 | 32 |
| **JBT0537** | Ac-FQSKGNVFVFGYFE-Nle-LRAKL-NH2 (SEQ ID NO: 761) | | | 0 | 0 |
| **JBT0538** | Ac-FQSKGNVFVFGYFERL-Nle-AKL-NH2 (SEQ ID NO: 425) | | | 16 | 20 |
| **JBT0564** | Ac-FQSKKNVFVFGYFKRLRAKL-NH2 (SEQ ID NO: 205) | 4.12 | 54 | 19 | 6 |
| **JBT0578** | Ac-FQSKKNVFVFGYFFRLRAKL-NH2 (SEQ ID NO: 441) | | | 1 | 0 |
| **JBT0613** | Ac-FQSKGNVFVFGYFERLRAKL-OH (SEQ ID NO: 283) | | | 21 | 8 |
| **JBT0614** | NH2-FQSKGNVFVFGYFERLRAKL-OH (SEQ ID NO: 720) | | | 3 | 0 |
| **JBT0615** | NH2-FQSKGNVFVFGYFERLRAKL-NH2 (SEQ ID NO: 284) | | | 14 | 5 |
| **JBT0616** | NH2-GSFQSKKNVFVDGYFERLRAKL-OH (SEQ ID NO: 285) | 0.85 | 30 | 25 | |
| **JBT0636** | Ac-FQSK-Nmg-NVFVDGYFARLRAKL-NH2 (SEQ ID NO: 47) | 0.10 | 90 | 86 | 76 |
| **JBT0651** | Ac-FQSKGNVHVKGYFERLRAKL-NH2 (SEQ ID NO: 48) | 0.59 | 50 | 40 | 26 |
| **JBT0652** | Ac-FQSKGNVHVDGYFERLRAKL-NH2 (SEQ ID NO: 49) | 0.34 | 52 | 48 | 34 |
| **JBT0653** | Ac-FQSPGNVHVKGYFERLRAKL-NH2 (SEQ ID NO: 50) | 0.44 | 57 | 47 | 33 |
| **JBT0654** | Ac-FQSPGNVHVDGYFERLRAKL-NH2 (SEQ ID NO: 51) | 0.37 | 60 | 50 | 36 |
| **JBT0655** | Ac-FQSKGNIFVFGYFERLRAKL-NH2 (SEQ ID NO: 52) | 1.32 | 65 | 41 | 22 |
| **JBT0656** | Ac-FQSKGNLFVFGYFERLRAKL-NH2 (SEQ ID NO: 286) | | | 21 | 10 |
| **JBT0657** | Ac-FQSKGNVFIFGYFERLRAKL-NH2 (SEQ ID NO: 287) | | | 24 | 10 |

FIGURE 22G

| | | | | | |
|---|---|---|---|---|---|
| **JBT0658** | Ac-FQSKGNVFLFGYFERLRAKL-NH2 (SEQ ID NO: 694) | | | 6 | 3 |
| **JBT0663** | Ac-FQSKaNVFVFGYFERLRAKL-NH2 (SEQ ID NO: 53) | 0.29 | 86 | 81 | 60 |
| **JBT0668** | Ac-FQSKaNVFVTGYFARLRAKL-NH2 (SEQ ID NO: 54) | 0.52 | 84 | 70 | 43 |
| **JBT0681** | Ac-FQSK-Nmg-AVFVFGYFARLRAKL-NH2 (SEQ ID NO: 206) | | | 52 | 52 |
| **JBT0683** | Ac-FQSK-Nmg-AVFVDGYFARLRAKL-NH2 (SEQ ID NO: 55) | 0.13 | 91 | 86 | 74 |
| **JBT0696** | Ac-FQSKKAVFVFGYFERLRAKL-NH2 (SEQ ID NO: 288) | 0.71 | 56 | 48 | 26 |
| **JBT0697** | Ac-FQSKGNVFVDGYFERL-Dap-AKL-NH2 (SEQ ID NO: 56) | 0.50 | 89 | 73 | 52 |
| **JBT0699** | Ac-FQSKGNVFVDGYFERL-Orn-AKL-NH2 (SEQ ID NO: 57) | 0.41 | 89 | 76 | 57 |
| **JBT0700** | Ac-FQSKGNVFVDGYFERL-Nva-AKL-NH2 (SEQ ID NO: 58) | 0.19 | 83 | 77 | 64 |
| **JBT0704** | Ac-FQSKKNVFVFGYFARLRAKL-NH2 (SEQ ID NO: 289) | | | 19 | 8 |
| **JBT0708** | Ac-FQSKaNVFVAGYFERLRAKL-NH2 (SEQ ID NO: 59) | 0.25 | 89 | 77 | 59 |
| **JBT0714** | Ac-FQSKaAVFVDGYFARLRAKL-NH2 (SEQ ID NO: 60) | 0.18 | 81 | 75 | 59 |
| **JBT0717** | Ac-FQSK-Nmg-NVFVDGYFERLRAKL-NH2 (SEQ ID NO: 61) | 0.06 | 91 | 87 | 84 |
| **JBT0720** | Ac-FQSK-Nmg-NVFVTGYFARLRAKL-NH2 (SEQ ID NO: 62) | 0.22 | 85 | 77 | 62 |
| **JBT0732** | Ac-FQSKGNVFVDGYFERL-Hci-AKL-NH2 (SEQ ID NO: 63) | 0.18 | 83 | 75 | 62 |
| **JBT0733** | Ac-FQSKGNVFVDGYFERL-Har-AKL-NH2 (SEQ ID NO: 64) | 0.18 | 81 | 75 | 62 |
| **JBT0739** | Ac-FQSKGNVFVDGYFERL-Opa-AKL-NH2 (SEQ ID NO: 65) | 0.28 | 82 | 74 | 51 |
| **JBT0740** | Ac-FQSKGNVFVDGYFERL-Aib-AKL-NH2 (SEQ ID NO: 66) | 0.09 | 87 | 84 | 78 |
| **JBT0754** | Ac-FQSK-Nmg-AVFVTGYFARLRAKL-NH2 (SEQ ID NO: 67) | 0.24 | 80 | 74 | 57 |
| **JBT0757** | Ac-FQsKKNVFVTGYFERLRAKL-NH2 (SEQ ID NO: 699) | | | 3 | 1 |
| **JBT0759** | Ac-FQSKkNVFVFGYFERLRAKL-NH2 (SEQ ID NO: 207) | 0.65 | 60 | 53 | 29 |
| **JBT0765** | Ac-FQSKGNVFVDGYFERL-Eew-AKL-NH2 (SEQ ID NO: 68) | 0.16 | 95 | 87 | 73 |
| **JBT0775** | Ac-FQSKGNVFVTGYFDRLRAKL-NH2 (SEQ ID NO: 69) | 0.77 | 77 | 57 | 34 |
| **JBT0778** | Ac-FQSKGNVFVKGYFDRLRAKL-NH2 (SEQ ID NO: 209) | 1.48 | 77 | 46 | 23 |
| **JBT0779** | Ac-FQSKGNVFVEGYFDRLRAKL-NH2 (SEQ ID NO: 210) | 0.77 | 82 | 59 | 37 |
| **JBT0780** | Ac-FQSK-Nmg-NVFVFGYFARLRAKL-NH2 (SEQ ID NO: 70) | | | 45 | 54 |
| **JBT0781** | Ac-FQSKGNVFVDGYFKRLRAKL-NH2 (SEQ ID NO: 211) | 1.25 | 81 | 48 | 25 |
| **JBT0789** | Ac-FQSK-Nmg-NVFVDGYFERL-Nle-AKL-NH2 (SEQ ID NO: 71) | 0.06 | 86 | 84 | 77 |
| **JBT0806** | Ac-FQSK-Nmg-NVFVAGYFARLRAKL-NH2 (SEQ ID NO: 74) | 0.13 | 79 | 75 | 65 |

FIGURE 22H

| | | | | | |
|---|---|---|---|---|---|
| **JBT0837** | Ac-FQSK-Nmg-NVFVTGYFERL-Nle-AKL-NH2 (SEQ ID NO: 213) | 0.20 | 76 | 70 | 54 |
| **JBT0844** | Ac-FQSKaNVFVDGYFERLRAKL-NH2 (SEQ ID NO: 300) | 0.32 | 84 | 72 | 51 |
| **JBT0850** | Ac-FQSKaAVFVAGYFARLRAKL-NH2 (SEQ ID NO: 302) | 0.19 | 75 | 70 | 55 |
| **JBT0854** | Ac-FQSKaAVFVAGYFARL-Nle-AKL-NH2 (SEQ ID NO: 490) | 0.29 | 49 | 47 | 36 |
| **JBT0870** | Ac-FQSKaAVFVTGYFARLRAKL-NH2 (SEQ ID NO: 214) | 0.31 | 84 | 80 | 57 |
| **JBT0886** | Ac-FQSKaNVFVDGYFARLRAKL-NH2 (SEQ ID NO: 215) | 0.36 | 83 | 71 | 48 |
| **JBT0894** | Ac-FQSKGNVFVDGYFERLHAKL-NH2 (SEQ ID NO: 76) | 0.39 | 95 | 80 | 56 |
| **JBT0919** | Ac-FQSKaNVFVTGYFERLRAKL-NH2 (SEQ ID NO: 79) | 0.36 | 86 | 74 | 51 |
| **JBT0931** | Ac-FQSKGNVFVDGYFERL-Eag-AKL-NH2 (SEQ ID NO: 879) | 0.42 | 91 | 75 | 52 |
| **JBT0946** | Ac-FQSKGNVFVDGYFERL-Dab-AKL-NH2 (SEQ ID NO: 85) | 0.27 | 85 | 74 | 56 |
| **JBT0950** | Ac-FQSKaNVFVFGYFARLRAKL-NH2 (SEQ ID NO: 217) | | | 47 | 31 |
| **JBT0973** | Ac-FQSKGNVFVDGYFERL-Cha-AKL-NH2 (SEQ ID NO: 92) | 0.16 | 70 | 65 | 58 |
| **JBT1006** | Ac-FQSKGNVFVDGYFERL-Hle-AKL-NH2 (SEQ ID NO: 96) | 0.17 | 77 | 71 | 61 |
| **JBT1035** | Ac-FQSK-Nmg-AVFVAGYFARL-Nle-AKL-NH2 (SEQ ID NO: 218) | | | | 53 |
| **JBT1037** | Ac-FQSKGNVFVDGYFERL-Nle-AKL-NH2 (SEQ ID NO: 104) | 0.22 | 74 | 68 | 55 |
| **JBT1043** | Ac-FQSKaNVFVDGYFERL-Nle-AKL-NH2 (SEQ ID NO: 106) | 0.30 | 80 | 70 | 51 |
| **JBT1082** | Ac-FQSKaAVFVFGYFARLRAKL-NH2 (SEQ ID NO: 565) | 0.20 | 47 | 45 | 38 |
| **JBT1084** | Ac-FQSK-Nmg-AVFVAGYFARLRAKL-NH2 (SEQ ID NO: 109) | 0.21 | 66 | 62 | 51 |
| **JBT1106** | Ac-FQSKGNVFVDGYFWRLRAKL-NH2 (SEQ ID NO: 220) | 0.28 | 94 | 79 | 65 |
| **JBT1122** | Ac-FQSK-Nmg-NVFVDGYFARL-Nle-AKL-NH2 (SEQ ID NO: 113) | | | 67 | 65 |
| **JBT1131** | Biotin-Ttds-FQSKGNVFVDGYFERLRAKL-NH2 (SEQ ID NO: 977) | 0.20 | 94 | 86 | 69 |
| **JBT1133** | Ac-FQSKkAVFVDGYFARLRAKL-NH2 (SEQ ID NO: 115) | 0.22 | 80 | 72 | 57 |
| **JBT1134** | Ac-FQSKGAVFVDGYFARLRAKL-NH2 (SEQ ID NO: 116) | 0.24 | 72 | 66 | 54 |
| **JBT1135** | Ac-FQSKDAVFVDGYFARLRAKL-NH2 (SEQ ID NO: 221) | 0.39 | 68 | 61 | 38 |
| **JBT1136** | Ac-FQSKdAVFVDGYFARLRAKL-NH2 (SEQ ID NO: 117) | 0.17 | 77 | 72 | 58 |
| **JBT1137** | Ac-FQSKkAVFVAGYFARLRAKL-NH2 (SEQ ID NO: 118) | 0.32 | 71 | 58 | 40 |
| **JBT1138** | Ac-FQSKGAVFVAGYFARLRAKL-NH2 (SEQ ID NO: 222) | 0.25 | 50 | 47 | 38 |
| **JBT1139** | Ac-FQSKDAVFVAGYFARLRAKL-NH2 (SEQ ID NO: 223) | | | 48 | 26 |
| **JBT1140** | Ac-FQSKdAVFVAGYFARLRAKL-NH2 (SEQ ID NO: 119) | 0.21 | 62 | 58 | 47 |

FIGURE 22I

| | | | | | |
|---|---|---|---|---|---|
| **JBT1141** | Ac-FQSKkAVFVKGYFARLRAKL-NH2 (SEQ ID NO: 120) | 0.37 | 62 | 54 | 38 |
| **JBT1142** | Ac-FQSKGAVFVKGYFARLRAKL-NH2 (SEQ ID NO: 224) | 0.39 | 49 | 47 | 32 |
| **JBT1143** | Ac-FQSKDAVFVKGYFARLRAKL-NH2 (SEQ ID NO: 225) | 0.84 | 54 | 40 | 19 |
| **JBT1144** | Ac-FQSKdAVFVKGYFARLRAKL-NH2 (SEQ ID NO: 121) | 0.32 | 63 | 57 | 38 |
| **JBT1145** | Ac-FQSKkAVFVTGYFARLRAKL-NH2 (SEQ ID NO: 122) | 0.39 | 66 | 60 | 38 |
| **JBT1146** | Ac-FQSKGAVFVTGYFARLRAKL-NH2 (SEQ ID NO: 226) | | | 41 | 28 |
| **JBT1147** | Ac-FQSKDAVFVTGYFARLRAKL-NH2 (SEQ ID NO: 227) | | | 48 | 24 |
| **JBT1148** | Ac-FQSKdAVFVTGYFARLRAKL-NH2 (SEQ ID NO: 123) | 0.33 | 68 | 61 | 44 |
| **JBT1149** | Ac-FQSKGNVFvFGYFERLRAKL-NH2 (SEQ ID NO: 936) | | | 0 | 0 |
| **JBT1151** | Ac-FQSKKNVFVFGYFERLRAKD-NH2 (SEQ ID NO: 937) | | | 0 | 0 |
| **JBT1152** | Ac-FQSKKNVFFFGYFERLRAKL-NH2 (SEQ ID NO: 735) | | | 0 | 0 |
| **JBT1153** | Ac-FQSKKNVFVFGYFERLGAKL-NH2 (SEQ ID NO: 705) | 5.25 | 51 | 12 | 0 |
| **JBT1155** | Ac-FQSK-Nmg-NVFVTGYFERLRAKL-NH2 (SEQ ID NO: 125) | 0.21 | 87 | 77 | 61 |
| **JBT1156** | Ac-FQSKaNVFVDGYFARL-Nle-AKL-NH2 (SEQ ID NO: 126) | | | 67 | 44 |
| **JBT1157** | Ac-FQSKaNVFVAGYFARLRAKL-NH2 (SEQ ID NO: 127) | 0.27 | 77 | 69 | 51 |
| **JBT1158** | Ac-FQSKGNVFVFGYFERLRAKL-N-methyl (SEQ ID NO: 228) | | | 73 | 45 |
| **JBT1159** | Ac-FQSKGNVFVFGYFERLRAKL-N-ethyl (SEQ ID NO: 128) | | | 71 | 41 |
| **JBT1160** | Ac-FQSKGNVFVFGYFERLRAKL-N-propyl (SEQ ID NO: 978) | | | 76 | 54 |
| **JBT1161** | Ac-FQSK-Aib-NVFVFGYFERLRAKL-NH2 (SEQ ID NO: 338) | | | 71 | 46 |
| **JBT1162** | Ac-FQSKpNVFVFGYFERLRAKL-NH2 (SEQ ID NO: 129) | 0.03 | 94 | 92 | 90 |
| **JBT1396** | Ac-FQSK-Nmg-NVFVAGYFERLRAKL-NH2 (SEQ ID NO: 161) | 0.05 | 95 | 93 | 87 |
| **JBT1584** | Ac-FQSK-Nmg-NVFVDGYFERL-Aib-AKL-NH2 (SEQ ID NO: 164) | 0.02 | 93 | 93 | 92 |
| **JBT1585** | Ac-FQSK-Nmg-NVFVTGYFERL-Aib-AKL-NH2 (SEQ ID NO: 165) | 0.04 | 90 | 90 | 89 |
| **JBT1587** | Ac-FQSKGNVFVDGYFERL-Aib-AKLC-NH2 (SEQ ID NO: 167) | 0.05 | 90 | 88 | 83 |
| **JBT1590** | Ac-FQSKGNVFV[CGYFERL-Aib-AKLC]-NH2 (SEQ ID NO: 401) | | | 53 | 21 |
| **JBT1591** | Ac-FQSKGNVFVDGYF[CRL-Aib-AKLC]-NH2 (SEQ ID NO: 168) | 0.67 | 81 | 72 | 41 |
| **JBT1592** | Ac-[CFQSKGNVFVDGYFERLC]AKL-NH2 (SEQ ID NO: 402) | 1.55 | 86 | 54 | 24 |
| **JBT1593** | Ac-FQSK[CNVFVDGYFERLC]AKL-NH2 (SEQ ID NO: 670) | | | 43 | 18 |
| **JBT1594** | Ac-FQSKGNVFV[CGYFERLC]AKL-NH2 (SEQ ID NO: 671) | | | 9 | 5 |

FIGURE 22J

| | | | | | |
|---|---|---|---|---|---|
| **JBT1595** | Ac-[CFQSKGNVFVC]GYFERL-Aib-AKL-NH2 (SEQ ID NO: 403) | | | 32 | 14 |
| **JBT1596** | Ac-[CFQSKGC]VFVEGYFERL-Aib-AKL-NH2 (SEQ ID NO: 404) | | | 52 | 24 |
| **JBT1597** | Ac-DGYFERLRAKL-NH2 (SEQ ID NO: 960) | | | 0 | 0 |
| **JBT1598** | Ac-FQSKKNV-NH2 (SEQ ID NO: 961) | | | 0 | 0 |
| **JBT1843** | Ac-FQSKGNIFVDGYFERLHAKL-NH2 (SEQ ID NO: 169) | 0.81 | 94 | 70 | 42 |
| **JBT1844** | Ac-FQSKNNVFVDGYFKRLRAKL-NH2 (SEQ ID NO: 170) | 0.73 | 91 | 70 | 42 |
| **JBT1845** | Ac-FQSYKHVFVDGYFERLRAKL-NH2 (SEQ ID NO: 249) | 1.24 | 94 | 61 | 33 |
| **JBT1846** | Ac-FQSKGIVFVDGYFKRLRAKL-NH2 (SEQ ID NO: 250) | 0.87 | 91 | 65 | 38 |
| **JBT1847** | Ac-YQTKGNVFVDGYFERLRAKL-NH2 (SEQ ID NO: 171) | 0.12 | 87 | 82 | 73 |
| **JBT1852** | PEG(1kD)-FQSKGNVFVDGYFERL-Aib-AKL-NH2 (SEQ ID NO: 174) | 0.11 | 93 | 88 | 76 |
| **JBT1853** | PEG(40kD)-FQSKGNVFVDGYFERL-Aib-AKL-NH2 (SEQ ID NO: 175) | 0.17 | 99 | 91 | 75 |
| **JBT1854** | Ac-FQSKGNVFVDGYFERL-Aib-AKLC(PEG1kD)-NH2 (SEQ ID NO: 176) | 0.07 | 93 | 90 | 83 |
| **JBT1855** | Ac-FQSKGNVFVDGYFERL-Aib-AKLC(PEG40kD)-NH2 (SEQ ID NO: 252) | 0.10 | 97 | 91 | 79 |

FIGURE 23A

| JBT0120 class | | FXa Inhibition assay | | | |
|---|---|---|---|---|---|
| | | | | | |
| **Peptide** | **Sequence** | **EC50 (µM)** | **Maximal inhibition (%)** | **% Inhibition @ 2.5µM** | **% Inhibition @ 0.63µM** |
| **JBT0120** | Ac-SGASRYKWF[CGMRDMKGTMSC]VWVKFRYDTS-NH2 (SEQ ID NO: 1047) | 1.21 | 75 | 47 | 26 |
| **JBT0124** | Biotin-Ttds-SGASRYKWF[CGMRDMKGTMSC]VWVKFRYDTS-NH2 (SEQ ID NO: 1290) | 1.59 | | 41 | |
| **JBT0247** | Ac-SGASRYKWFCGMRDMKGTMSCVWVKFRYDTS-NH2 (SEQ ID NO: 1213) | 0.79 | | 42 | |
| **JBT0248** | Ac-KKSGASRYKWF[CGMRDMKGTMSC]VWVKFRYDTSKK-NH2 (SEQ ID NO: 1001) | 0.82 | | 53 | |
| **JBT0249** | Ac-KKSGASRYKWFCGMRDMKGTMSKK-NH2 (SEQ ID NO: 1214) | | | 0 | |
| **JBT0250** | Ac-KKSRYKWF[CGMRDMKGTMSC]VWKK-NH2 (SEQ ID NO: 1201) | | | 11 | |
| **JBT0251** | Ac-KKKWF[CGMRDMKGTMSC]VWVKFKK-NH2 (SEQ ID NO: 1202) | | | 17 | |
| **JBT0252** | Ac-KK[CGMRDMKGTMSC]VWVKFRYDKK-NH2 (SEQ ID NO: 1215) | | | 13 | |
| **JBT0253** | Ac-KKMRDMKGTMSCVWVKFRYDTSKK-NH2 (SEQ ID NO: 1216) | | | 0 | |
| **JBT0319** | Ac-SGASRYKWF[CGMRDMKGTMSC]VWVKFRY-NH2 (SEQ ID NO: 1002) | 0.30 | | 72 | |
| **JBT0320** | Ac-SGASRYKWF[CGMRDMKGTMSC]VWVK-NH2 (SEQ ID NO: 1103) | | | 9 | |
| **JBT0321** | Ac-SGASRYKWF[CGMRDMKGTMSC]V-NH2 (SEQ ID NO: 1217) | | | 0 | |
| **JBT0322** | Ac-SGASRYKWFCGMRDMKGTM-NH2 (SEQ ID NO: 1218) | | | 0 | |
| **JBT0322** | Ac-SGASRYKWFCGMRDMKGTM-NH2 (SEQ ID NO: 1218) | | | 0 | |
| **JBT0323** | Ac-SRYKWF[CGMRDMKGTMSC]VWVKFRYDTS-NH2 (SEQ ID NO: 1076) | 0.72 | | 42 | |
| **JBT0324** | Ac-KWF[CGMRDMKGTMSC]VWVKFRYDTS-NH2 (SEQ ID NO: 1155) | | | 0 | |
| **JBT0325** | Ac-[CGMRDMKGTMSC]VWVKFRYDTS-NH2 (SEQ ID NO: 1219) | | | 0 | |
| **JBT0326** | Ac-RDMKGTMSCVWVKFRYDTS-NH2 (SEQ ID NO: 1220) | | | 0 | |
| **JBT0327** | Ac-SGASRYKWFCGMRDMKGTMS-NH2 (SEQ ID NO: 1222) | | | 0 | |
| **JBT0328** | Ac-SRYKWF[CGMRDMKGTMSC]VW-NH2 (SEQ ID NO: 1223) | | | 0 | |

FIGURE 23B

| | | | | | |
|---|---|---|---|---|---|
| **JBT0329** | Ac-KWF[CGMRDMKGTMSC]VWVKF-NH2 (SEQ ID NO: 1156) | | | 2 | |
| **JBT0330** | Ac-[CGMRDMKGTMSC]VWVKFRYD-NH2 (SEQ ID NO: 1224) | | | 0 | |
| **JBT0331** | Ac-MRDMKGTMSCVWVKFRYDTS-NH2 (SEQ ID NO: 1225) | | | 0 | |
| **JBT0332** | Ac-SRYKWFCGMRDMKGTMSCVW-NH2 (SEQ ID NO: 1206) | | | 1 | |
| **JBT0333** | Ac-KWFCGMRDMKGTMSCVWVKF-NH2 (SEQ ID NO: 1207) | | | 4 | |
| **JBT0334** | Ac-CGMRDMKGTMSCVWVKFRYD-NH2 (SEQ ID NO: 1227) | | | 0 | |
| **JBT0409** | Ac-SGASRYKWFSGMRDMKGTMSSVWVKFRYDTS-NH2 (SEQ ID NO: 1204) | | | 0 | |
| **JBT0410** | Ac-SGASRYKWFSG-Nle-RD-Nle-KGT-Nle-SSVWVKFRYDTS-NH2 (SEQ ID NO: 1208) | | | 0 | |
| **JBT0411** | Ac-SGASRYKWF[CG-Nle-RD-Nle-KGT-Nle-SC]VWVKFRYDTS-NH2 (SEQ ID NO: 1104) | | | 11 | |
| **JBT0412** | Ac-KWF[CG-Nle-RD-Nle-KGT-Nle-SC]VWVKF-NH2 (SEQ ID NO: 1209) | | | 7 | |
| **JBT0413** | Ac-KWFSGMRDMKGTMSSVWVKF-NH2 (SEQ ID NO: 1228) | | | 0 | |
| **JBT0414** | Ac-KWFSG-Nle-RD-Nle-KGT-Nle-SSVWVKF-NH2 (SEQ ID NO: 1205) | | | 4 | |
| **JBT0415** | Ac-SRYKWF[CGMRDMKGTMSC]VWVKF-NH2 (SEQ ID NO: 1003) | 0.52 | 73 | 59 | 39 |
| **JBT0416** | Ac-SRYKWF[CG-Nle-RD-Nle-KGT-Nle-SC]VWVKF-NH2 (SEQ ID NO: 1077) | | | 52 | |
| **JBT0417** | Ac-SRYKWFSGMRDMKGTMSSVWVKF-NH2 (SEQ ID NO: 1229) | | | 0 | |
| **JBT0418** | Ac-SRYKWFSG-Nle-RD-Nle-KGT-Nle-SSVWVKF-NH2 (SEQ ID NO: 1210) | | | 4 | |
| **JBT0419** | Ac-SGGRKHKHFLRSNGKPSRALSSMHFWRWSTS-NH2 (SEQ ID NO: 1293) | | | 6 | |
| **JBT0435** | Ac-RKRDVSGKM[CWSGFGSKWFRC]ADMMTYYSVT-NH2 (SEQ ID NO: 1211) | | | 0 | |
| **JBT0436** | Ac-RWSGKSTYS[CDAMVRRMGMKC]FSFGWTDVYK-NH2 (SEQ ID NO: 1212) | | | 0 | |
| **JBT0437** | Ac-ARYKWF[CGMRDMKGTMSC]VWVKF-NH2 (SEQ ID NO: 1048) | | | 71 | |
| **JBT0438** | Ac-SAYKWF[CGMRDMKGTMSC]VWVKF-NH2 (SEQ ID NO: 1078) | | | 54 | |
| **JBT0439** | Ac-SRAKWF[CGMRDMKGTMSC]VWVKF-NH2 (SEQ ID NO: 1105) | | | 35 | |
| **JBT0440** | Ac-SRYAWF[CGMRDMKGTMSC]VWVKF-NH2 (SEQ ID NO: 1106) | | | 37 | |
| **JBT0441** | Ac-SRYKAF[CGMRDMKGTMSC]VWVKF-NH2 (SEQ ID NO: 1230) | | | 0 | |
| **JBT0442** | Ac-SRYKWA[CGMRDMKGTMSC]VWVKF-NH2 (SEQ ID NO: 1231) | | | 8 | |
| **JBT0443** | Ac-SRYKWFAGMRDMKGTMSCVWVKF-NH2 (SEQ ID NO: 1157) | | | 0 | |
| **JBT0444** | Ac-SRYKWF[CAMRDMKGTMSC]VWVKF-NH2 (SEQ ID NO: 1004) | 0.24 | 90 | 80 | 62 |

FIGURE 23C

| | | | | | |
|---|---|---|---|---|---|
| **JBT0445** | Ac-SRYKWF[CGARDMKGTMSC]VWVKF-NH2 (SEQ ID NO: 1107) | | | 18 | |
| **JBT0446** | Ac-SRYKWF[CGMADMKGTMSC]VWVKF-NH2 (SEQ ID NO: 1079) | | | 50 | |
| **JBT0447** | Ac-SRYKWF[CGMRAMKGTMSC]VWVKF-NH2 (SEQ ID NO: 1158) | | | 11 | |
| **JBT0448** | Ac-SRYKWF[CGMRDAKGTMSC]VWVKF-NH2 (SEQ ID NO: 1108) | | | 44 | |
| **JBT0449** | Ac-SRYKWF[CGMRDMAGTMSC]VWVKF-NH2 (SEQ ID NO: 1080) | 1.26 | 82 | 46 | 30 |
| **JBT0450** | Ac-SRYKWF[CGMRDMKATMSC]VWVKF-NH2 (SEQ ID NO: 1159) | | | 33 | |
| **JBT0451** | Ac-SRYKWF[CGMRDMKGAMSC]VWVKF-NH2 (SEQ ID NO: 1081) | | | 54 | |
| **JBT0452** | Ac-SRYKWF[CGMRDMKGTASC]VWVKF-NH2 (SEQ ID NO: 1109) | | | 39 | |
| **JBT0453** | Ac-SRYKWF[CGMRDMKGTMAC]VWVKF-NH2 (SEQ ID NO: 1110) | 1.18 | 62 | 38 | 23 |
| **JBT0454** | Ac-SRYKWFCGMRDMKGTMSAVWVKF-NH2 (SEQ ID NO: 1160) | | | 0 | |
| **JBT0455** | Ac-SRYKWF[CGMRDMKGTMSC]AWVKF-NH2 (SEQ ID NO: 1049) | 1.02 | 65 | 40 | 26 |
| **JBT0456** | Ac-SRYKWFCGMRDMKGTMSCVAVKF-NH2 (SEQ ID NO: 1232) | | | 3 | |
| **JBT0457** | Ac-SRYKWF[CGMRDMKGTMSC]VWAKF-NH2 (SEQ ID NO: 1161) | | | 16 | |
| **JBT0458** | Ac-SRYKWF[CGMRDMKGTMSC]VWVAF-NH2 (SEQ ID NO: 1082) | 1.34 | 66 | 39 | 24 |
| **JBT0459** | Ac-SRYKWF[CGMRDMKGTMSC]VWVKA-NH2 (SEQ ID NO: 1083) | | | 47 | |
| **JBT0460** | Ac-RYKWF[CGMRDMKGTMSC]VWVKF-NH2 (SEQ ID NO: 1050) | | | 57 | |
| **JBT0461** | Ac-YKWF[CGMRDMKGTMSC]VWVKF-NH2 (SEQ ID NO: 1111) | | | 32 | |
| **JBT0462** | Ac-SRYKWFGM[CRDMKGTMSC]VWVKF-NH2 (SEQ ID NO: 1233) | | | 0 | |
| **JBT0463** | Ac-SRYKWFGMRD[CMKGTMSC]VWVKF-NH2 (SEQ ID NO: 1234) | | | 0 | |
| **JBT0464** | Ac-SRYKWFGMRDMK[CGTMSC]VWVKF-NH2 (SEQ ID NO: 1235) | | | 0 | |
| **JBT0465** | Ac-SRYKWF[CGMRDMKGTC]MSVWVKF-NH2 (SEQ ID NO: 1236) | | | 0 | |
| **JBT0466** | Ac-SRYKWF[CGMRDMKC]GTMSVWVKF-NH2 (SEQ ID NO: 1237) | | | 0 | |
| **JBT0467** | Ac-SRYKWF[CGMRDC]MKGTMSVWVKF-NH2 (SEQ ID NO: 1238) | | | 0 | |
| **JBT0468** | Ac-SRYKWFG[CMRDMKGTMC]SVWVKF-NH2 (SEQ ID NO: 1239) | | | 2 | |
| **JBT0469** | Ac-SRYKWFGM[CRDMKGTC]MSVWVKF-NH2 (SEQ ID NO: 1240) | | | 5 | |
| **JBT0470** | Ac-SRYKWFGMR[CDMKGC]TMSVWVKF-NH2 (SEQ ID NO: 1162) | | | 0 | |
| **JBT0617** | Ac-SRYKWF[homoC-GMRDMKGTMSC]VWVKF-NH2 (SEQ ID NO: 1112) | 1.91 | 35 | 18 | 8 |
| **JBT0618** | Ac-SRYKWF[CGMRDMKGTMS-homoC]VWVKF-NH2 (SEQ ID NO: 1163) | 3.44 | 18 | 5 | 1 |
| **JBT0619** | Ac-SRYKWF[homoC-GMRDMKGTMS-homoC]VWVKF-NH2 (SEQ ID NO: 1241) | | | 0 | 0 |

FIGURE 23D

| | | | | | |
|---|---|---|---|---|---|
| **JBT0620** | Ac-SRYKWF[Dap-GMRDMKGTMS-D]VWVKF-NH2 (SEQ ID NO: 1242) | | | 0 | 0 |
| **JBT0623** | Ac-SRYKWF[KGMRDMKGTMSD]VWVKF-NH2 (SEQ ID NO: 1243) | | | 3 | 2 |
| **JBT0625** | Ac-SRYKWF[CMRDMKGTMSC]VWVKF-NH2 (SEQ ID NO: 1244) | | | 0 | 0 |
| **JBT0626** | Ac-SRYKWF[CGMRDKGTMSC]VWVKF-NH2 (SEQ ID NO: 1164) | | | 3 | 0 |
| **JBT0627** | Ac-SRYKWF[CGMRDMGTMSC]VWVKF-NH2 (SEQ ID NO: 1165) | | | 2 | 0 |
| **JBT0628** | Ac-SRYKWF[CGMRDMKGMSC]VWVKF-NH2 (SEQ ID NO: 1166) | | | 0 | 0 |
| **JBT0629** | Ac-SRYKWF[cGMRDMKGTMSC]VWVKF-NH2 (SEQ ID NO: 1167) | | | 0 | 0 |
| **JBT0631** | Ac-SRYKWF[CGmRDMKGTMSC]VWVKF-NH2 (SEQ ID NO: 1113) | 1.89 | 62 | 33 | 15 |
| **JBT0632** | Ac-SRYKWF[CGMrDMKGTMSC]VWVKF-NH2 (SEQ ID NO: 1245) | | | 0 | 0 |
| **JBT0633** | Ac-SRYKWF[CGMRdMKGTMSC]VWVKF-NH2 (SEQ ID NO: 1168) | | | 0 | 0 |
| **JBT0634** | Ac-SRYKWF[CGMRDmKGTMSC]VWVKF-NH2 (SEQ ID NO: 1051) | 0.69 | 63 | 47 | 26 |
| **JBT0635** | Ac-SRYKWF[CGMRDMkGTMSC]VWVKF-NH2 (SEQ ID NO: 1114) | 5.14 | 48 | 13 | 2 |
| **JBT0637** | Ac-SRYKWF[CGMRDMKGtMSC]VWVKF-NH2 (SEQ ID NO: 1169) | | | 0 | 0 |
| **JBT0638** | Ac-SRYKWF[CGMRDMKGTmSC]VWVKF-NH2 (SEQ ID NO: 1246) | | | 0 | 0 |
| **JBT0639** | Ac-SRYKWF[CGMRDMKGTMsC]VWVKF-NH2 (SEQ ID NO: 1170) | | | 2 | 0 |
| **JBT0640** | Ac-SRYKWF[CGMRDMKGTMSc]VWVKF-NH2 (SEQ ID NO: 1171) | | | 3 | 0 |
| **JBT0641** | Ac-SRYKWF[CPMRDMKGTMSC]VWVKF-NH2 (SEQ ID NO: 1247) | | | 4 | 2 |
| **JBT0642** | Ac-SRYKWF[CGPRDMKGTMSC]VWVKF-NH2 (SEQ ID NO: 1248) | | | 2 | 1 |
| **JBT0643** | Ac-SRYKWF[CGMPDMKGTMSC]VWVKF-NH2 (SEQ ID NO: 1006) | | | 45 | 26 |
| **JBT0644** | Ac-SRYKWF[CGMRPMKGTMSC]VWVKF-NH2 (SEQ ID NO: 1172) | 4.55 | 35 | 12 | 3 |
| **JBT0645** | Ac-SRYKWF[CGMRDPKGTMSC]VWVKF-NH2 (SEQ ID NO: 1084) | 3.79 | 62 | 27 | 12 |
| **JBT0646** | Ac-SRYKWF[CGMRDMPGTMSC]VWVKF-NH2 (SEQ ID NO: 1173) | | | 4 | 1 |
| **JBT0647** | Ac-SRYKWF[CGMRDMKPTMSC]VWVKF-NH2 (SEQ ID NO: 1249) | | | 4 | 2 |
| **JBT0648** | Ac-SRYKWF[CGMRDMKGPMSC]VWVKF-NH2 (SEQ ID NO: 1174) | | | 4 | 0 |
| **JBT0649** | Ac-SRYKWF[CGMRDMKGTPSC]VWVKF-NH2 (SEQ ID NO: 1175) | | | 5 | 2 |
| **JBT0650** | Ac-SRYKWF[CGMRDMKGTMPC]VWVKF-NH2 (SEQ ID NO: 1250) | | | 0 | 0 |
| **JBT0659** | Biotinyl-Ttds-SRYKWF[CGMRDMKGTMSC]VWVKF-NH2 (SEQ ID NO: 1291) | | | 63 | 38 |
| **JBT0787** | Ac-SRYKWF[CG-SeMet-RD-SeMet-KGT-SeMet-SC]VWVKF-NH2 (SEQ ID NO: 1292) | | | 68 | 56 |

FIGURE 23E

| | | | | | |
|---|---|---|---|---|---|
| **JBT1416** | Ac-DRYKWF[CGMRDMKGTMSC]VWVKF-NH2 (SEQ ID NO: 1007) | 0.58 | 93 | 68 | 46 |
| **JBT1417** | Ac-SDYKWF[CGMRDMKGTMSC]VWVKF-NH2 (SEQ ID NO: 1116) | | | 34 | 13 |
| **JBT1418** | Ac-SRDKWF[CGMRDMKGTMSC]VWVKF-NH2 (SEQ ID NO: 1176) | | | 15 | 5 |
| **JBT1419** | Ac-SRYDWF[CGMRDMKGTMSC]VWVKF-NH2 (SEQ ID NO:1117) | | | 31 | 10 |
| **JBT1420** | Ac-SRYKDF[CGMRDMKGTMSC]VWVKF-NH2 (SEQ ID NO: 1251) | | | 0 | 0 |
| **JBT1421** | Ac-SRYKWD[CGMRDMKGTMSC]VWVKF-NH2 (SEQ ID NO: 1252) | | | 2 | 2 |
| **JBT1422** | Ac-SRYKWF[CDMRDMKGTMSC]VWVKF-NH2 (SEQ ID NO: 1253) | | | 0 | 0 |
| **JBT1423** | Ac-SRYKWF[CGDRDMKGTMSC]VWVKF-NH2 (SEQ ID NO: 1177) | | | 1 | 0 |
| **JBT1424** | Ac-SRYKWF[CGMDDMKGTMSC]VWVKF-NH2 (SEQ ID NO: 1254) | | | 4 | 1 |
| **JBT1425** | Ac-SRYKWF[CGMRDDKGTMSC]VWVKF-NH2 (SEQ ID NO: 1085) | | | 53 | 28 |
| **JBT1426** | Ac-SRYKWF[CGMRDMDGTMSC]VWVKF-NH2 (SEQ ID NO: 1008) | 0.19 | 96 | 81 | 66 |
| **JBT1427** | Ac-SRYKWF[CGMRDMKDTMSC]VWVKF-NH2 (SEQ ID NO: 1052) | | | 57 | 31 |
| **JBT1428** | Ac-SRYKWF[CGMRDMKGDMSC]VWVKF-NH2 (SEQ ID NO: 1118) | | | 28 | 6 |
| **JBT1429** | Ac-SRYKWF[CGMRDMKGTDSC]VWVKF-NH2 (SEQ ID NO: 1086) | | | 49 | 21 |
| **JBT1430** | Ac-SRYKWF[CGMRDMKGTMDC]VWVKF-NH2 (SEQ ID NO: 1119) | | | 37 | 15 |
| **JBT1431** | Ac-SRYKWF[CGMRDMKGTMSC]DWVKF-NH2 (SEQ ID NO: 1255) | | | 0 | 0 |
| **JBT1432** | Ac-SRYKWF[CGMRDMKGTMSC]VDVKF-NH2 (SEQ ID NO: 1256) | | | 0 | 0 |
| **JBT1433** | Ac-SRYKWF[CGMRDMKGTMSC]VWDKF-NH2 (SEQ ID NO: 1257) | | | 0 | 0 |
| **JBT1434** | Ac-SRYKWF[CGMRDMKGTMSC]VWVDF-NH2 (SEQ ID NO: 1120) | | | 28 | 9 |
| **JBT1435** | Ac-SRYKWF[CGMRDMKGTMSC]VWVKD-NH2 (SEQ ID NO: 1009) | | | 61 | 34 |
| **JBT1436** | Ac-FRYKWF[CGMRDMKGTMSC]VWVKF-NH2 (SEQ ID NO: 1053) | 0.68 | 95 | 71 | 45 |
| **JBT1437** | Ac-SFYKWF[CGMRDMKGTMSC]VWVKF-NH2 (SEQ ID NO: 1010) | 0.27 | 95 | 80 | 64 |
| **JBT1438** | Ac-SRFKWF[CGMRDMKGTMSC]VWVKF-NH2 (SEQ ID NO: 1011) | 0.69 | 88 | 64 | 43 |
| **JBT1439** | Ac-SRYFWF[CGMRDMKGTMSC]VWVKF-NH2 (SEQ ID NO: 1121) | | | 35 | 14 |
| **JBT1440** | Ac-SRYKFF[CGMRDMKGTMSC]VWVKF-NH2 (SEQ ID NO: 1258) | | | 3 | 2 |
| **JBT1441** | Ac-SRYKWF[CFMRDMKGTMSC]VWVKF-NH2 (SEQ ID NO: 1259) | | | 7 | 4 |
| **JBT1442** | Ac-SRYKWF[CGFRDMKGTMSC]VWVKF-NH2 (SEQ ID NO: 1778) | | | 10 | 3 |
| **JBT1443** | Ac-SRYKWF[CGMFDMKGTMSC]VWVKF-NH2 (SEQ ID NO: 1779) | | | 22 | 7 |
| **JBT1444** | Ac-SRYKWF[CGMRFMKGTMSC]VWVKF-NH2 (SEQ ID NO: 1260) | | | 7 | 5 |

FIGURE 23F

| | | | | | |
|---|---|---|---|---|---|
| **JBT1445** | Ac-SRYKWF[CGMRDFKGTMSC]VWVKF-NH2 (SEQ ID NO: 1012) | 0.77 | 89 | 64 | 41 |
| **JBT1446** | Ac-SRYKWF[CGMRDMFGTMSC]VWVKF-NH2 (SEQ ID NO: 1054) | 0.68 | 93 | 69 | 45 |
| **JBT1447** | Ac-SRYKWF[CGMRDMKFTMSC]VWVKF-NH2 (SEQ ID NO: 1227) | | | 46 | 21 |
| **JBT1448** | Ac-SRYKWF[CGMRDMKGFMSC]VWVKF-NH2 (SEQ ID NO: 1123) | 0.99 | 86 | 60 | 34 |
| **JBT1449** | Ac-SRYKWF[CGMRDMKGTFSC]VWVKF-NH2 (SEQ ID NO: 1013) | 0.40 | 89 | 74 | 53 |
| **JBT1450** | Ac-SRYKWF[CGMRDMKGTMFC]VWVKF-NH2 (SEQ ID NO: 1124) | | | 44 | 17 |
| **JBT1451** | Ac-SRYKWF[CGMRDMKGTMSC]FWVKF-NH2 (SEQ ID NO: 1087) | | | 34 | 11 |
| **JBT1452** | Ac-SRYKWF[CGMRDMKGTMSC]VFVKF-NH2 (SEQ ID NO: 1125) | | | 27 | 5 |
| **JBT1453** | Ac-SRYKWF[CGMRDMKGTMSC]VWFKF-NH2 (SEQ ID NO: 1261) | | | 6 | 1 |
| **JBT1454** | Ac-SRYKWF[CGMRDMKGTMSC]VWVFF-NH2 (SEQ ID NO: 1262) | | | 47 | 22 |
| **JBT1455** | Ac-GRYKWF[CGMRDMKGTMSC]VWVKF-NH2 (SEQ ID NO: 1014) | 0.79 | 87 | 62 | 40 |
| **JBT1456** | Ac-SGYKWF[CGMRDMKGTMSC]VWVKF-NH2 (SEQ ID NO: 1126) | | | 41 | 15 |
| **JBT1457** | Ac-SRGKWF[CGMRDMKGTMSC]VWVKF-NH2 (SEQ ID NO: 1180) | | | 15 | 4 |
| **JBT1458** | Ac-SRYGWF[CGMRDMKGTMSC]VWVKF-NH2 (SEQ ID NO: 1127) | | | 32 | 10 |
| **JBT1459** | Ac-SRYKGF[CGMRDMKGTMSC]VWVKF-NH2 (SEQ ID NO: 1263) | | | 0 | 0 |
| **JBT1460** | Ac-SRYKWG[CGMRDMKGTMSC]VWVKF-NH2 (SEQ ID NO: 1264) | | | 0 | 0 |
| **JBT1461** | Ac-SRYKWF[CGGRDMKGTMSC]VWVKF-NH2 (SEQ ID NO: 1181) | | | 8 | 0 |
| **JBT1462** | Ac-SRYKWF[CGMGDMKGTMSC]VWVKF-NH2 (SEQ ID NO: 1128) | | | 33 | 15 |
| **JBT1463** | Ac-SRYKWF[CGMRGMKGTMSC]VWVKF-NH2 (SEQ ID NO: 1129) | | | 23 | 10 |
| **JBT1464** | Ac-SRYKWF[CGMRDGKGTMSC]VWVKF-NH2 (SEQ ID NO: 1088) | | | 50 | 25 |
| **JBT1465** | Ac-SRYKWF[CGMRDMGGTMSC]VWVKF-NH2 (SEQ ID NO: 1015) | 0.84 | 92 | 60 | 41 |
| **JBT1466** | Ac-SRYKWF[CGMRDMKGGMSC]VWVKF-NH2 (SEQ ID NO: 1055) | | | 53 | 26 |
| **JBT1467** | Ac-SRYKWF[CGMRDMKGTGSC]VWVKF-NH2 (SEQ ID NO: 1130) | | | 27 | 11 |
| **JBT1468** | Ac-SRYKWF[CGMRDMKGTMGC]VWVKF-NH2 (SEQ ID NO: 1131) | | | 25 | 9 |
| **JBT1469** | Ac-SRYKWF[CGMRDMKGTMSC]GWVKF-NH2 (SEQ ID NO: 1182) | | | 4 | 0 |
| **JBT1470** | Ac-SRYKWF[CGMRDMKGTMSC]VGVKF-NH2 (SEQ ID NO: 1265) | | | 0 | 0 |
| **JBT1471** | Ac-SRYKWF[CGMRDMKGTMSC]VWGKF-NH2 (SEQ ID NO: 1266) | | | 4 | 0 |
| **JBT1472** | Ac-SRYKWF[CGMRDMKGTMSC]VWVGF-NH2 (SEQ ID NO: 1089) | | | 48 | 21 |
| **JBT1473** | Ac-SRYKWF[CGMRDMKGTMSC]VWVKG-NH2 (SEQ ID NO: 1090) | | | 40 | 16 |

FIGURE 23G

| | | | | | |
|---|---|---|---|---|---|
| **JBT1474** | Ac-KRYKWF[CGMRDMKGTMSC]VWVKF-NH2 (SEQ ID NO: 1016) | 0.37 | 90 | 75 | 55 |
| **JBT1475** | Ac-SKYKWF[CGMRDMKGTMSC]VWVKF-NH2 (SEQ ID NO: 1056) | | | 63 | 37 |
| **JBT1476** | Ac-SRKKWF[CGMRDMKGTMSC]VWVKF-NH2 (SEQ ID NO: 1132) | | | 31 | 11 |
| **JBT1477** | Ac-SRYKKF[CGMRDMKGTMSC]VWVKF-NH2 (SEQ ID NO: 1267) | | | 0 | 0 |
| **JBT1478** | Ac-SRYKWK[CGMRDMKGTMSC]VWVKF-NH2 (SEQ ID NO: 1091) | | | 45 | 18 |
| **JBT1479** | Ac-SRYKWF[CKMRDMKGTMSC]VWVKF-NH2 (SEQ ID NO: 1183) | | | 14 | 2 |
| **JBT1480** | Ac-SRYKWF[CGKRDMKGTMSC]VWVKF-NH2 (SEQ ID NO: 1133) | | | 27 | 9 |
| **JBT1481** | Ac-SRYKWF[CGMKDMKGTMSC]VWVKF-NH2 (SEQ ID NO: 1017) | 0.37 | 88 | 71 | 54 |
| **JBT1482** | Ac-SRYKWF[CGMRKMKGTMSC]VWVKF-NH2 (SEQ ID NO: 1184) | | | 9 | 1 |
| **JBT1483** | Ac-SRYKWF[CGMRDKKGTMSC]VWVKF-NH2 (SEQ ID NO: 1057) | 0.99 | 83 | 60 | 32 |
| **JBT1484** | Ac-SRYKWF[CGMRDMKKTMSC]VWVKF-NH2 (SEQ ID NO: 1134) | | | 30 | 10 |
| **JBT1485** | Ac-SRYKWF[CGMRDMKGKMSC]VWVKF-NH2 (SEQ ID NO: 1058) | | | 56 | 32 |
| **JBT1486** | Ac-SRYKWF[CGMRDMKGTKSC]VWVKF-NH2 (SEQ ID NO: 1059) | | | 58 | 34 |
| **JBT1487** | Ac-SRYKWF[CGMRDMKGTMKC]VWVKF-NH2 (SEQ ID NO: 1135) | | | 30 | 9 |
| **JBT1488** | Ac-SRYKWF[CGMRDMKGTMSC]KWVKF-NH2 (SEQ ID NO: 1268) | | | 3 | 0 |
| **JBT1489** | Ac-SRYKWF[CGMRDMKGTMSC]VKVKF-NH2 (SEQ ID NO: 1269) | | | 0 | 0 |
| **JBT1490** | Ac-SRYKWF[CGMRDMKGTMSC]VWKKF-NH2 (SEQ ID NO: 1270) | | | 0 | 1 |
| **JBT1491** | Ac-SRYKWF[CGMRDMKGTMSC]VWVKK-NH2 (SEQ ID NO: 1136) | | | 26 | 6 |
| **JBT1492** | Ac-LRYKWF[CGMRDMKGTMSC]VWVKF-NH2 (SEQ ID NO: 1018) | 0.47 | 91 | 72 | 52 |
| **JBT1493** | Ac-SLYKWF[CGMRDMKGTMSC]VWVKF-NH2 (SEQ ID NO: 1060) | 0.48 | 96 | 74 | 54 |
| **JBT1494** | Ac-SRLKWF[CGMRDMKGTMSC]VWVKF-NH2 (SEQ ID NO: 1137) | | | 22 | 6 |
| **JBT1495** | Ac-SRYLWF[CGMRDMKGTMSC]VWVKF-NH2 (SEQ ID NO: 1138) | | | 30 | 10 |
| **JBT1496** | Ac-SRYKLF[CGMRDMKGTMSC]VWVKF-NH2 (SEQ ID NO: 1271) | | | 0 | 0 |
| **JBT1497** | Ac-SRYKWL[CGMRDMKGTMSC]VWVKF-NH2 (SEQ ID NO: 1061) | | | 58 | 33 |
| **JBT1498** | Ac-SRYKWF[CLMRDMKGTMSC]VWVKF-NH2 (SEQ ID NO: 1272) | | | 3 | 1 |
| **JBT1499** | Ac-SRYKWF[CGLRDMKGTMSC]VWVKF-NH2 (SEQ ID NO: 1139) | | | 21 | 7 |
| **JBT1500** | Ac-SRYKWF[CGMLDMKGTMSC]VWVKF-NH2 (SEQ ID NO: 1062) | | | 60 | 34 |
| **JBT1501** | Ac-SRYKWF[CGMRLMKGTMSC]VWVKF-NH2 (SEQ ID NO: 1185) | | | 14 | 3 |
| **JBT1502** | Ac-SRYKWF[CGMRDLKGTMSC]VWVKF-NH2 (SEQ ID NO: 1019) | 0.33 | 93 | 76 | 59 |

FIGURE 23H

| | | | | | |
|---|---|---|---|---|---|
| **JBT1503** | Ac-SRYKWF[CGMRDMLGTMSC]VWVKF-NH2 (SEQ ID NO: 1063) | 0.53 | 83 | 66 | 44 |
| **JBT1504** | Ac-SRYKWF[CGMRDMKLTMSC]VWVKF-NH2 (SEQ ID NO: 1140) | | | 37 | 13 |
| **JBT1505** | Ac-SRYKWF[CGMRDMKGLMSC]VWVKF-NH2 (SEQ ID NO: 1092) | | | 66 | 42 |
| **JBT1506** | Ac-SRYKWF[CGMRDMKGTLSC]VWVKF-NH2 (SEQ ID NO: 1064) | 0.89 | 91 | 63 | 39 |
| **JBT1507** | Ac-SRYKWF[CGMRDMKGTMLC]VWVKF-NH2 (SEQ ID NO: 10141) | | | 35 | 11 |
| **JBT1508** | Ac-SRYKWF[CGMRDMKGTMSC]LWVKF-NH2 (SEQ ID NO: 1093) | | | 52 | 27 |
| **JBT1509** | Ac-SRYKWF[CGMRDMKGTMSC]VLVKF-NH2 (SEQ ID NO: 1273) | | | 3 | 0 |
| **JBT1510** | Ac-SRYKWF[CGMRDMKGTMSC]VWLKF-NH2 (SEQ ID NO: 1094) | | | 51 | 27 |
| **JBT1511** | Ac-SRYKWF[CGMRDMKGTMSC]VWVLF-NH2 (SEQ ID NO: 1142) | | | 52 | 27 |
| **JBT1512** | Ac-SRYKWF[CGMRDMKGTMSC]VWVKL-NH2 (SEQ ID NO: 1020) | 0.37 | 91 | 72 | 55 |
| **JBT1513** | Ac-SSYKWF[CGMRDMKGTMSC]VWVKF-NH2 (SEQ ID NO: 1065) | | | 63 | 40 |
| **JBT1514** | Ac-SRSKWF[CGMRDMKGTMSC]VWVKF-NH2 (SEQ ID NO: 1066) | | | 51 | 27 |
| **JBT1515** | Ac-SRYSWF[CGMRDMKGTMSC]VWVKF-NH2 (SEQ ID NO: 1143) | | | 32 | 11 |
| **JBT1516** | Ac-SRYKSF[CGMRDMKGTMSC]VWVKF-NH2 (SEQ ID NO: 1274) | | | 0 | 0 |
| **JBT1517** | Ac-SRYKWS[CGMRDMKGTMSC]VWVKF-NH2 (SEQ ID NO: 1275) | | | 1 | 0 |
| **JBT1518** | Ac-SRYKWF[CSMRDMKGTMSC]VWVKF-NH2 (SEQ ID NO: 1021) | | | 62 | 39 |
| **JBT1519** | Ac-SRYKWF[CGSRDMKGTMSC]VWVKF-NH2 (SEQ ID NO: 1186) | | | 11 | 3 |
| **JBT1520** | Ac-SRYKWF[CGMSDMKGTMSC]VWVKF-NH2 (SEQ ID NO: 1095) | | | 45 | 20 |
| **JBT1521** | Ac-SRYKWF[CGMRSMKGTMSC]VWVKF-NH2 (SEQ ID NO: 1096) | | | 44 | 21 |
| **JBT1522** | Ac-SRYKWF[CGMRDSKGTMSC]VWVKF-NH2 (SEQ ID NO: 1067) | | | 56 | 32 |
| **JBT1523** | Ac-SRYKWF[CGMRDMSGTMSC]VWVKF-NH2 (SEQ ID NO: 1022) | 0.50 | 91 | 70 | 51 |
| **JBT1524** | Ac-SRYKWF[CGMRDMKSTMSC]VWVKF-NH2 (SEQ ID NO: 1144) | | | 39 | 16 |
| **JBT1525** | Ac-SRYKWF[CGMRDMKGSMSC]VWVKF-NH2 (SEQ ID NO: 1068) | | | 68 | 46 |
| **JBT1526** | Ac-SRYKWF[CGMRDMKGTSSC]VWVKF-NH2 (SEQ ID NO: 1069) | | | 53 | 32 |
| **JBT1527** | Ac-SRYKWF[CGMRDMKGTMSC]SWVKF-NH2 (SEQ ID NO: 1097) | | | 43 | 20 |
| **JBT1528** | Ac-SRYKWF[CGMRDMKGTMSC]VSVKF-NH2 (SEQ ID NO: 1276) | | | 2 | 0 |
| **JBT1529** | Ac-SRYKWF[CGMRDMKGTMSC]VWSKF-NH2 (SEQ ID NO: 1277) | | | 1 | 0 |
| **JBT1530** | Ac-SRYKWF[CGMRDMKGTMSC]VWVSF-NH2 (SEQ ID NO: 1070) | | | 54 | 31 |
| **JBT1531** | Ac-SRYKWF[CGMRDMKGTMSC]VWVKS-NH2 (SEQ ID NO: 1071) | | | 50 | 28 |

FIGURE 23I

| | | | | | |
|---|---|---|---|---|---|
| **JBT1532** | Ac-PRYKWF[CGMRDMKGTMSC]VWVKF-NH2 (SEQ ID NO: 1072) | | | 62 | 38 |
| **JBT1533** | Ac-SPYKWF[CGMRDMKGTMSC]VWVKF-NH2 (SEQ ID NO: 1145) | | | 31 | 10 |
| **JBT1534** | Ac-SRPKWF[CGMRDMKGTMSC]VWVKF-NH2 (SEQ ID NO: 1187) | | | 2 | 0 |
| **JBT1535** | Ac-SRYPWF[CGMRDMKGTMSC]VWVKF-NH2 (SEQ ID NO: 1278) | | | 0 | 1 |
| **JBT1536** | Ac-SRYKPF[CGMRDMKGTMSC]VWVKF-NH2 (SEQ ID NO: 1279) | | | 0 | 0 |
| **JBT1537** | Ac-SRYKWP[CGMRDMKGTMSC]VWVKF-NH2 (SEQ ID NO: 1280) | | | 0 | 0 |
| **JBT1538** | Ac-SRYKWF[CGMRDMKGTMSC]PWVKF-NH2 (SEQ ID NO: 1281) | | | 2 | 2 |
| **JBT1539** | Ac-SRYKWF[CGMRDMKGTMSC]VPVKF-NH2 (SEQ ID NO: 1282) | | | 0 | 0 |
| **JBT1540** | Ac-SRYKWF[CGMRDMKGTMSC]VWPKF-NH2 (SEQ ID NO: 1283) | | | 0 | 0 |
| **JBT1541** | Ac-SRYKWF[CGMRDMKGTMSC]VWVPF-NH2 (SEQ ID NO: 1023) | 0.47 | 89 | 69 | 49 |
| **JBT1542** | Ac-SRYKWF[CGMRDMKGTMSC]VWVKP-NH2 (SEQ ID NO: 1188) | | | 15 | 3 |
| **JBT1543** | Ac-SRYKWF[CGMRDMKGTMSC]VWVKF-OH (SEQ ID NO: 1098) | | | 44 | 20 |
| **JBT1544** | H-SRYKWF[CGMRDMKGTMSC]VWVKF-NH2 (SEQ ID NO: 1024) | 0.64 | 88 | 67 | 44 |
| **JBT1545** | H-SRYKWF[CGMRDMKGTMSC]VWVKF-OH (SEQ ID NO: 1099) | | | 40 | 20 |
| **JBT1546** | Ac-SRYKWF[CEMRDMKGTMSC]VWVKF-NH2 (SEQ ID NO: 1284) | | | 3 | 2 |
| **JBT1547** | Ac-SRYKWF[CHMRDMKGTMSC]VWVKF-NH2 (SEQ ID NO: 1285) | | | 2 | 0 |
| **JBT1548** | Ac-SRYKWF[CIMRDMKGTMSC]VWVKF-NH2 (SEQ ID NO: 1286) | | | 6 | 3 |
| **JBT1549** | Ac-SRYKWF[CMMRDMKGTMSC]VWVKF-NH2 (SEQ ID NO: 1189) | | | 9 | 3 |
| **JBT1550** | Ac-SRYKWF[CNMRDMKGTMSC]VWVKF-NH2 (SEQ ID NO: 1190) | | | 20 | 10 |
| **JBT1551** | Ac-SRYKWF[CQMRDMKGTMSC]VWVKF-NH2 (SEQ ID NO: 1146) | | | 31 | 13 |
| **JBT1552** | Ac-SRYKWF[CRMRDMKGTMSC]VWVKF-NH2 (SEQ ID NO: 1147) | | | 32 | 12 |
| **JBT1553** | Ac-SRYKWF[CTMRDMKGTMSC]VWVKF-NH2 (SEQ ID NO: 1148) | | | 36 | 15 |
| **JBT1554** | Ac-SRYKWF[CVMRDMKGTMSC]VWVKF-NH2 (SEQ ID NO: 1287) | | | 6 | 2 |
| **JBT1555** | Ac-SRYKWF[CWMRDMKGTMSC]VWVKF-NH2 (SEQ ID NO: 1191) | | | 8 | 2 |
| **JBT1556** | Ac-SRYKWF[CYMRDMKGTMSC]VWVKF-NH2 (SEQ ID NO: 1288) | | | 5 | 0 |
| **JBT1557** | H-RYKWF[CGMRDMKGTMSC]VWVKF-NH2 (SEQ ID NO: 173) | | | 53 | 27 |
| **JBT1558** | H-YKWF[CGMRDMKGTMSC]VWVKF-NH2 (SEQ ID NO: 1149) | | | 17 | 3 |
| **JBT1559** | Ac-SRYKWF[CGaRDMKGTMSC]VWVKF-NH2 (SEQ ID NO: 1150) | | | 29 | 10 |
| **JBT1560** | Ac-SRYKWF[CGdRDMKGTMSC]VWVKF-NH2 (SEQ ID NO: 1289) | | | 1 | 1 |

FIGURE 23J

| | | | | | |
|---|---|---|---|---|---|
| **JBT1561** | Ac-SRYKWF[CGfRDMKGTMSC]VWVKF-NH2 (SEQ ID NO: 1192) | | | 9 | 1 |
| **JBT1562** | Ac-SRYKWF[CGkRDMKGTMSC]VWVKF-NH2 (SEQ ID NO: 1193) | | | 5 | 1 |
| **JBT1563** | Ac-SRYKWF[CGlRDMKGTMSC]VWVKF-NH2 (SEQ ID NO: 1194) | | | 14 | 6 |
| **JBT1564** | Ac-SRYKWF[CGpRDMKGTMSC]VWVKF-NH2 (SEQ ID NO: 1100) | | | 65 | 40 |
| **JBT1565** | Ac-SRYKWF[CGsRDMKGTMSC]VWVKF-NH2 (SEQ ID NO: 1195) | | | 13 | 3 |
| **JBT1566** | Ac-SRYKWF[CGMRDaKGTMSC]VWVKF-NH2 (SEQ ID NO: 1151) | | | 33 | 13 |
| **JBT1567** | Ac-SRYKWF[CGMRDdKGTMSC]VWVKF-NH2 (SEQ ID NO: 1101) | | | 45 | 21 |
| **JBT1568** | Ac-SRYKWF[CGMRDfKGTMSC]VWVKF-NH2 (SEQ ID NO: 1074) | | | 63 | 38 |
| **JBT1569** | Ac-SRYKWF[CGMRDkKGTMSC]VWVKF-NH2 (SEQ ID NO: 1102) | | | 50 | 23 |
| **JBT1570** | Ac-SRYKWF[CGMRDlKGTMSC]VWVKF-NH2 (SEQ ID NO: 1025) | 0.74 | 88 | 62 | 43 |
| **JBT1571** | Ac-SRYKWF[CGMRDpKGTMSC]VWVKF-NH2 (SEQ ID NO: 1196) | | | 15 | 5 |
| **JBT1572** | Ac-SRYKWF[CGMRDsKGTMSC]VWVKF-NH2 (SEQ ID NO: 1152) | | | 28 | 9 |
| **JBT1573** | Ac-SRYKWF[CGMRDMaGTMSC]VWVKF-NH2 (SEQ ID NO: 1197) | | | 20 | 4 |
| **JBT1574** | Ac-SRYKWF[CGMRDMdGTMSC]VWVKF-NH2 (SEQ ID NO: 1153) | | | 39 | 15 |
| **JBT1575** | Ac-SRYKWF[CGMRDMfGTMSC]VWVKF-NH2 (SEQ ID NO: 1198) | | | 18 | 3 |
| **JBT1576** | Ac-SRYKWF[CGMRDMlGTMSC]VWVKF-NH2 (SEQ ID NO: 1199) | | | 19 | 6 |
| **JBT1577** | Ac-SRYKWF[CGMRDMpGTMSC]VWVKF-NH2 (SEQ ID NO: 1200) | | | 14 | 2 |
| **JBT1578** | Ac-SRYKWF[CGMRDMsGTMSC]VWVKF-NH2 (SEQ ID NO: 1154) | | | 30 | 10 |

FIGURE 24A

| JBT0122 class | | FXa Inhibition assay | | | |
|---|---|---|---|---|---|
| | | | | | |
| **Peptide** | **Sequence** | **EC50 (µM)** | **Maximal inhibition (%)** | **% Inhibition @ 2.5µM** | **% Inhibition @ 0.63µM** |
| **JBT0122** | AC-SGYASFPLAVQLHVSKRSKEMALARLYYKTS-NH2 (SEQ ID NO: 2002) | 7.92 | | 23 | |
| **JBT0126** | Biotin-Ttds-SGYASFPLAVQLHVSKRSKEMALARLYYKTS-NH2 (SEQ ID NO: 2498) | 14.10 | | 17 | |
| **JBT0221** | Ac-KKSGYASFPLAVQLHVSKRSKEMALARLYYKTSKK-NH2 (SEQ ID NO: 2003) | | | 29 | |
| **JBT0222*** | Ac-MKSRSLGLAYFAKHSSLEVLQTRKVAAPYY-NH2 (SEQ ID NO: 2127) | | | 0 | |
| **JBT0223*** | Ac-KMQLRVYASTAHSRYLLGSSLFPKYAEVKA-NH2 (SEQ ID NO: 2297) | | | 0 | |
| **JBT0224** | Ac-KKSGYASFPLAVQLHVSKRSKEMALARLYYKK-NH2 (SEQ ID NO: 2298) | | | 26 | |
| **JBT0225** | Ac-KKSGYASFPLAVQLHVSKRSKEMALARKK-NH2 (SEQ ID NO: 2128) | | | 12 | |
| **JBT0226** | Ac-KKSGYASFPLAVQLHVSKRSKEMAKK-NH2 (SEQ ID NO: 2299) | | | 6 | |
| **JBT0227** | Ac-KKSGYASFPLAVQLHVSKRSKKK-NH2 (SEQ ID NO: 2300) | | | 0 | |
| **JBT0228** | Ac-KKASFPLAVQLHVSKRSKEMALARLYYKTSKK-NH2 (SEQ ID NO: 2016) | | | 21 | |
| **JBT0229** | Ac-KKPLAVQLHVSKRSKEMALARLYYKTSKK-NH2 (SEQ ID NO: 2129) | | | 0 | |
| **JBT0230** | Ac-KKVQLHVSKRSKEMALARLYYKTSKK-NH2 (SEQ ID NO: 2301) | | | 0 | |
| **JBT0231** | Ac-KKHVSKRSKEMALARLYYKTSKK-NH2 (SEQ ID NO: 2302) | | | 0 | |
| **JBT0232** | Ac-KKGYASFPLAVQLHVSKRSKEMKK-NH2 (SEQ ID NO: 2303) | | | 6 | |
| **JBT0233** | Ac-KKYASFPLAVQLHVSKRSKEMAKK-NH2 (SEQ ID NO: 2304) | | | 8 | |
| **JBT0234** | Ac-KKVQLHVSKRSKEMALARLYYKKK-NH2 (SEQ ID NO: 2305) | | | 0 | |
| **JBT0235** | Ac-KKQLHVSKRSKEMALARLYYKTKK-NH2 (SEQ ID NO: 2306) | | | 0 | |
| **JBT0236** | Ac-KKLHVSKRSKEMALARLYYKTSKK-NH2 (SEQ ID NO: 2307) | | | 0 | |
| **JBT0237** | Ac-KKSGYASFPLAVQLHVSKRSKEKK-NH2 (SEQ ID NO: 2308) | | | 0 | |
| **JBT0359** | Ac-ASFPLAVQLHVSKRSKEMA-NH2 (SEQ ID NO: 2309) | | | 0 | |

FIGURE 24B

| | | | | | |
|---|---|---|---|---|---|
| **JBT0360** | Ac-SFPLAVQLHVSKRSKEMA-NH2 (SEQ ID NO: 2310) | | | 1 | |
| **JBT0361** | Ac-FPLAVQLHVSKRSKEMA-NH2 (SEQ ID NO: 2311) | | | 0 | |
| **JBT0362** | Ac-ASFPLAVQLHVSKRSKEM-NH2 (SEQ ID NO: 2312) | | | 0 | |
| **JBT0363** | Ac-ASFPLAVQLHVSKRSKE-NH2 (SEQ ID NO: 2313) | | | 0 | |
| **JBT0364** | Ac-ASFPLAVQLHVSKRSKEMAL-NH2 (SEQ ID NO: 2314) | | | 2 | |
| **JBT0365** | Ac-ASFPLAVQLHVSKRSKEMALA-NH2 (SEQ ID NO: 2315) | | | 0 | |
| **JBT0366** | Ac-ASFPLAVQLHVSKRSKEMALAR-NH2 (SEQ ID NO: 2316) | | | 0 | |
| **JBT0367** | Ac-ASFPLAVQLHVSKRSKEMALARL-NH2 (SEQ ID NO: 2317) | | | 2 | |
| **JBT0368** | Ac-ASFPLAVQLHVSKRSKEMALARLY-NH2 (SEQ ID NO: 2130) | | | 0 | |
| **JBT0369** | Ac-ASFPLAVQLHVSKRSKEMALARLYY-NH2 (SEQ ID NO: 2017) | | | 2 | |
| **JBT0370** | Ac-YASFPLAVQLHVSKRSKEMA-NH2 (SEQ ID NO: 2318) | | | 2 | |
| **JBT0371** | Ac-GYASFPLAVQLHVSKRSKEMA-NH2 (SEQ ID NO: 2319) | | | 8 | |
| **JBT0660** | Ac-AGYASFPLAVQLHVSKRSKEMALARLYYKTS-NH2 (SEQ ID NO: 2004) | | | 5 | 2 |
| **JBT0661** | Ac-SAYASFPLAVQLHVSKRSKEMALARLYYKTS-NH2 (SEQ ID NO: 2005) | | | 13 | 5 |
| **JBT0662** | Ac-SGAASFPLAVQLHVSKRSKEMALARLYYKTS-NH2 (SEQ ID NO: 2131) | | | 4 | 0 |
| **JBT0664** | Ac-SGYAAFPLAVQLHVSKRSKEMALARLYYKTS-NH2 (SEQ ID NO: 2006) | | | 7 | 2 |
| **JBT0665** | Ac-SGYASAPLAVQLHVSKRSKEMALARLYYKTS-NH2 (SEQ ID NO: 2132) | | | 2 | 0 |
| **JBT0666** | Ac-SGYASFALAVQLHVSKRSKEMALARLYYKTS-NH2 (SEQ ID NO: 2001) | | | 12 | 6 |
| **JBT0667** | Ac-SGYASFPAAVQLHVSKRSKEMALARLYYKTS-NH2 (SEQ ID NO: 2018) | | | 2 | 0 |
| **JBT0669** | Ac-SGYASFPLAAQLHVSKRSKEMALARLYYKTS-NH2 (SEQ ID NO: 2133) | | | 0 | 0 |
| **JBT0670** | Ac-SGYASFPLAVALHVSKRSKEMALARLYYKTS-NH2 (SEQ ID NO: 2007) | | | 6 | 0 |
| **JBT0671** | Ac-SGYASFPLAVQAHVSKRSKEMALARLYYKTS-NH2 (SEQ ID NO: 2019) | | | 4 | 1 |
| **JBT0672** | Ac-SGYASFPLAVQLAVSKRSKEMALARLYYKTS-NH2 (SEQ ID NO: 2134) | | | 2 | 0 |
| **JBT0673** | Ac-SGYASFPLAVQLHASKRSKEMALARLYYKTS-NH2 (SEQ ID NO: 2135) | | | 0 | 0 |
| **JBT0674** | Ac-SGYASFPLAVQLHVAKRSKEMALARLYYKTS-NH2 (SEQ ID NO: 2008) | | | 10 | 3 |
| **JBT0675** | Ac-SGYASFPLAVQLHVSARSKEMALARLYYKTS-NH2 (SEQ ID NO: 2136) | | | 0 | 0 |
| **JBT0676** | Ac-SGYASFPLAVQLHVSKASKEMALARLYYKTS-NH2 (SEQ ID NO: 2137) | | | 0 | 0 |
| **JBT0677** | Ac-SGYASFPLAVQLHVSKRAKEMALARLYYKTS-NH2 (SEQ ID NO: 2009) | | | 4 | 0 |
| **JBT0678** | Ac-SGYASFPLAVQLHVSKRSAEMALARLYYKTS-NH2 (SEQ ID NO: 2010) | | | 6 | 2 |

FIGURE 24C

| | | | | | |
|---|---|---|---|---|---|
| **JBT0679** | Ac-SGYASFPLAVQLHVSKRSKAMALARLYYKTS-NH2 (SEQ ID NO: 2020) | | | 2 | 0 |
| **JBT0680** | Ac-SGYASFPLAVQLHVSKRSKEAALARLYYKTS-NH2 (SEQ ID NO: 2138) | | | 0 | 0 |
| **JBT0682** | Ac-SGYASFPLAVQLHVSKRSKEMAAARLYYKTS-NH2 (SEQ ID NO: 2139) | | | 2 | 0 |
| **JBT0684** | Ac-SGYASFPLAVQLHVSKRSKEMALAALYYKTS-NH2 (SEQ ID NO: 2011) | | | 5 | 1 |
| **JBT0685** | Ac-SGYASFPLAVQLHVSKRSKEMALARAYYKTS-NH2 (SEQ ID NO: 2021) | | | 4 | 0 |
| **JBT0686** | Ac-SGYASFPLAVQLHVSKRSKEMALARLAYKTS-NH2 (SEQ ID NO: 2140) | | | 3 | 0 |
| **JBT0687** | Ac-SGYASFPLAVQLHVSKRSKEMALARLYAKTS-NH2 (SEQ ID NO: 2141) | | | 3 | 0 |
| **JBT0688** | Ac-SGYASFPLAVQLHVSKRSKEMALARLYYATS-NH2 (SEQ ID NO: 2012) | | | 8 | 2 |
| **JBT0689** | Ac-SGYASFPLAVQLHVSKRSKEMALARLYYKAS-NH2 (SEQ ID NO: 2013) | | | 10 | 3 |
| **JBT0690** | Ac-SGYASFPLAVQLHVSKRSKEMALARLYYKTA-NH2 (SEQ ID NO: 2014) | | | 10 | 3 |
| **JBT1579** | Ac-GYASFPLAVQLHVAKRSKEMA-NH2 (SEQ ID NO: 2015) | | | 9 | 4 |
| **JBT1580** | Ac-GYASFALSVQLHVSKRSKEMA-NH2 (SEQ ID NO: 2320) | | | 3 | 1 |
| **JBT1581** | Ac-GYASFALAVQLHVAKRSKEMA-NH2 (SEQ ID NO: 2321) | | | 11 | 4 |
| **JBT1582** | Ac-GYASFPLAVQLHVMKRSKEMA-NH2 (SEQ ID NO: 2022) | | | 10 | 3 |
| **JBT1583** | Ac-GYASFALAVQLHVMKRSKEMA-NH2 (SEQ ID NO: 2322) | | | 18 | 5 |
| **JBT1599** | Ac-FPLAVQLHVSKRSKEMALA-NH2 (SEQ ID NO: 2323) | | | 0 | 0 |
| **JBT1600** | Ac-QLHVSKRSKEMALA-NH2 (SEQ ID NO: 2324) | | | 0 | 0 |
| **JBT1601** | Ac-SGYASFP-NH2 (SEQ ID NO: 2325) | | | 0 | 0 |
| **JBT1602** | Ac-LAVQLHVSKRSKEMALARL-NH2 (SEQ ID NO: 2326) | | | 0 | 0 |

FIGURE 25D

| **JBT0047 class** | | **Extrinsic Tenase Inhibition assay** | |
|---|---|---|---|
| | | | |
| **Peptide** | **Sequence** | **EC50 (µM)** | **% Inhibition @ 2.5µM** |
| **JBT0047** | Ac-SGVGRLQVAFQSKKNVFVFGYFERLRAKLTS-NH2 (SEQ ID NO: 253) | 1.37 | 20 |
| **JBT0051** | Biotin-Ttds-SGVGRLQVAFQSKKNVFVFGYFERLRAKLTS-NH2 (SEQ ID NO: 962) | 1.04 | 19 |
| **JBT0055** | Ac-SGVGRLQVAFQSKKNVFVFGYFERLRAKLTS-Ttds-Lysin(biotin)-NH2 (SEQ ID NO: 963) | 1.67 | 25 |
| **JBT0131** | Biotin-Ttds-AFQSKKNVFVFGYFERLRAK-NH2 (SEQ ID NO: 964) | 2.02 | 11 |
| **JBT0132** | Biotin-Ttds-FQSKKNVFVFGYFERLRAKL-NH2 (SEQ ID NO: 965) | | 11 |
| **JBT0133** | Biotin-Ttds-QSKKNVFVFGYFERLRAKLT-NH2 (SEQ ID NO: 966) | | 9 |
| **JBT0134** | Biotin-Ttds-QSKKNVFVFGYFERLRAK-NH2 (SEQ ID NO: 967) | | 3 |
| **JBT0155** | Ac-KKSGVGRLQVAFQSKKNVFVFGYFERLRAKLTSKK-NH2 (SEQ ID NO: 8) | 0.38 | 33 |
| **JBT0158** | Ac-KKSGVGRLQVAFQSKKNVFVFGYFERLRAKKK-NH2 (SEQ ID NO: 9) | | 23 |
| **JBT0159** | Ac-KKSGVGRLQVAFQSKKNVFVFGYFERLKK-NH2 (SEQ ID NO: 744) | | 18 |
| **JBT0160** | Ac-KKSGVGRLQVAFQSKKNVFVFGYFKK-NH2 (SEQ ID NO: 745) | | 22 |
| **JBT0161** | Ac-KKSGVGRLQVAFQSKKNVFVFKK-NH2 (SEQ ID NO: 746) | | 6 |
| **JBT0162** | Ac-KKGRLQVAFQSKKNVFVFGYFERLRAKLTSKK-NH2 (SEQ ID NO: 10) | 0.28 | 34 |
| **JBT0163** | Ac-KKQVAFQSKKNVFVFGYFERLRAKLTSKK-NH2 (SEQ ID NO: 11) | 0.89 | 31 |
| **JBT0164** | Ac-KKFQSKKNVFVFGYFERLRAKLTSKK-NH2 (SEQ ID NO: 12) | 2.68 | 24 |
| **JBT0165** | Ac-KKKKNVFVFGYFERLRAKLTSKK-NH2 (SEQ ID NO: 712) | | 15 |
| **JBT0166** | Biotinyl-Ttds-KKFQSKKNVFVFGYFERLRAKLKK-NH2 (SEQ ID NO: 968) | 1.95 | 36 |
| **JBT0169** | Ac-KKAFQSKKNVFVFGYFERLRAKKK-NH2 (SEQ ID NO: 254) | 2.35 | 20 |
| **JBT0170** | Ac-KKFQSKKNVFVFGYFERLRAKLKK-NH2 (SEQ ID NO: 13) | 1.90 | 30 |

FIGURE 25E

| | | | |
|---|---|---|---|
| **JBT0171** | Ac-KKQSKKNVFVFGYFERLRAKLTKK -NH2 (SEQ ID NO: 255) | 4.12 | 13 |
| **JBT0172** | Ac-KKQSKKNVFVFGYFERLRAKKK-NH2 (SEQ ID NO: 406) | 3.98 | 8 |
| **JBT0173** | Biotinyl-Ttds-SGVGRLQVAFQSKKNVFVFG-NH2 (SEQ ID NO: 971) | | 3 |
| **JBT0174** | Ac-KKAFQSKKNVFVFGYFERLRAKLKK-NH2 (SEQ ID NO: 14) | 2.90 | 26 |
| **JBT0175** | Ac-KKAFQSKKNVFVFGYFERLRAKLTKK-NH2 (SEQ ID NO: 182) | 2.29 | 26 |
| **JBT0293** | Ac-FQSKKNVFVFGYFERLRAKL-NH2 (SEQ ID NO: 256) | 1.62 | 16 |
| **JBT0294** | Ac-YQSKKNVFVFGYFERLRAKL-NH2 (SEQ ID NO: 257) | 5.31 | 9 |
| **JBT0295** | Ac-FSSKKNVFVFGYFERLRAKL-NH2 (SEQ ID NO: 713) | 1.80 | 10 |
| **JBT0296** | Ac-FQNKKNVFVFGYFERLRAKL-NH2 (SEQ ID NO: 407) | 7.83 | 10 |
| **JBT0297** | Ac-FQSKNNVFVFGYFERLRAKL-NH2 (SEQ ID NO: 183) | | 13 |
| **JBT0298** | Ac-FQSKQNVFVFGYFERLRAKL-NH2 (SEQ ID NO: 747) | | 15 |
| **JBT0299** | Ac-FQSKKNVFAFGYFERLRAKL-NH2 (SEQ ID NO: 408) | | 5 |
| **JBT0300** | Ac-FQSKKNVFSFGYFERLRAKL-NH2 (SEQ ID NO: 409) | | 3 |
| **JBT0301** | Ac-FQSKKNVFTFGYFERLRAKL-NH2 (SEQ ID NO: 410) | | 0 |
| **JBT0302** | Ac-FQSKKNVFVAGYFERLRAKL-NH2 (SEQ ID NO: 258) | | 3 |
| **JBT0303** | Ac-FQSKKNVFVDGYFERLRAKL-NH2 (SEQ ID NO: 184) | 8.80 | 9 |
| **JBT0304** | Ac-FQSKKNVFVLGYFERLRAKL-NH2 (SEQ ID NO: 259) | | 7 |
| **JBT0305** | Ac-FQSKKNVFVQGYFERLRAKL-NH2 (SEQ ID NO: 260) | | 0 |
| **JBT0306** | Ac-FQSKKNVFVSGYFERLRAKL-NH2 (SEQ ID NO: 185) | | 3 |
| **JBT0307** | Ac-FQSKKNVFVYGYFERLRAKL-NH2 (SEQ ID NO: 261) | 8.72 | 4 |
| **JBT0308** | Ac-FQSKKNVFVFGYKERLRAKL-NH2 (SEQ ID NO: 411) | | 4 |
| **JBT0309** | Ac-FQSKKNVFVFGYYERLRAKL-NH2 (SEQ ID NO: 412) | 8.55 | 7 |
| **JBT0310** | Ac-FQSKKNVFVFGYFDRLRAKL-NH2 (SEQ ID NO: 262) | | 5 |
| **JBT0311** | Ac-FQSKKNVFVFGYFERLRAKN-NH2 (SEQ ID NO: 748) | 3.72 | 10 |
| **JBT0335** | Ac-FQSKKNVFVFGYFERLRAK-NH2 (SEQ ID NO: 749) | 10.48 | 5 |
| **JBT0336** | Ac-FQSKNNVFVAGYFDRLRAKL-OH (SEQ ID NO: 263) | 12.13 | 5 |

FIGURE 25F

| | | | |
|---|---|---|---|
| **JBT0337** | Ac-FQSKNNVFVDGYFDRLRAKL-NH2 (SEQ ID NO: 16) | 13.33 | 15 |
| **JBT0338** | Ac-FQSKNNVFVQGYFDRLRAKL-NH2 (SEQ ID NO: 17) | 8.42 | 9 |
| **JBT0339** | Ac-FQSKNNVFVSGYFDRLRAKL-NH2 (SEQ ID NO: 18) | | 9 |
| **JBT0340** | Ac-FQSKNNVFVYGYFDRLRAKL-NH2 (SEQ ID NO: 186) | | 9 |
| **JBT0341** | Ac-FQSKNNVFVFGYFDRLRAKL-NH2 (SEQ ID NO: 187) | 8.68 | 10 |
| **JBT0342** | Ac-FQSKNNVFVDGYFERLRAKL-NH2 (SEQ ID NO: 19) | 7.15 | 18 |
| **JBT0343** | Ac-FQSKKNVFVDGYFDRLRAKL-NH2 (SEQ ID NO: 188) | | 8 |
| **JBT0374** | Ac-FQSKDNVFVFGYFERLRAKL-NH2 (SEQ ID NO: 20) | | 19 |
| **JBT0375** | Ac-FQSKGNVFVFGYFERLRAKL-NH2 (SEQ ID NO: 190) | 2.93 | 30 |
| **JBT0376** | Ac-FQSKKNAFVFGYFERLRAKL-NH2 (SEQ ID NO: 414) | | 3 |
| **JBT0377** | Ac-FQSKKNQFVFGYFERLRAKL-NH2 (SEQ ID NO: 264) | | 8 |
| **JBT0378** | Ac-FQSKKNVFVEGYFERLRAKL-NH2 (SEQ ID NO: 21) | 9.03 | 12 |
| **JBT0379** | Ac-FQSKKNVFVTGYFERLRAKL-NH2 (SEQ ID NO: 22) | | 6 |
| **JBT0380** | Ac-FQSKKNVFVVGYFERLRAKL-NH2 (SEQ ID NO: 191) | 7.58 | 10 |
| **JBT0381** | Ac-FQSPKNVFVFGYFERLRAKL-NH2 (SEQ ID NO: 265) | | 9 |
| **JBT0385** | Ac-FQSKKNNFVFGYFERLRAKL-NH2 (SEQ ID NO: 672) | | 2 |
| **JBT0386** | Ac-FQSKKNPFVFGYFERLRAKL-NH2 (SEQ ID NO: 415) | | 5 |
| **JBT0388** | Ac-FQSKKNVHVFGYFERLRAKL-NH2 (SEQ ID NO: 192) | | 6 |
| **JBT0389** | Ac-FQSKKNVVVFGYFERLRAKL-NH2 (SEQ ID NO: 673) | | 8 |
| **JBT0390** | Ac-FQSKKNVFQFGYFERLRAKL-NH2 (SEQ ID NO: 674) | | 5 |
| **JBT0391** | Ac-FQSKKNVFVGGYFERLRAKL-NH2 (SEQ ID NO: 266) | | 1 |
| **JBT0392** | Ac-FQSKKNVFVHGYFERLRAKL-NH2 (SEQ ID NO: 23) | | 4 |
| **JBT0393** | Ac-FQSKKNVFVKGYFERLRAKL-NH2 (SEQ ID NO: 193) | | 3 |
| **JBT0394** | Ac-FQSKKNVFVMGYFERLRAKL-NH2 (SEQ ID NO: 24) | 4.38 | 8 |
| **JBT0395** | Ac-FQSKKNVFVNGYFERLRAKL-NH2 (SEQ ID NO: 25) | | 7 |
| **JBT0396** | Ac-FQSKKNVFVPGYFERLRAKL-NH2 (SEQ ID NO: 194) | 8.71 | 6 |

FIGURE 25G

| | | | |
|---|---|---|---|
| **JBT0397** | Ac-FQSKKNVFVRGYFERLRAKL-NH2 (SEQ ID NO: 195) | | 4 |
| **JBT0398** | Ac-FQSKKNVFVFGYFEELRAKL-NH2 (SEQ ID NO: 196) | | 8 |
| **JBT0399** | Ac-FQSKKNVFVFGYFELLRAKL-NH2 (SEQ ID NO: 750) | | 7 |
| **JBT0400** | Ac-FQSKKNVFVFGYFLRLRAKL-NH2 (SEQ ID NO: 267) | | 13 |
| **JBT0401** | Ac-FQSKKNVFVFGYFERLRAVL-NH2 (SEQ ID NO: 416) | | 4 |
| **JBT0402** | Biotin-Ttds-FQSKNNVFVFGYFERLRAKL-NH2 (SEQ ID NO: 973) | | 11 |
| **JBT0403** | Biotin-Ttds-FQSKKNVFVDGYFERLRAKL-NH2 (SEQ ID NO: 972) | | 9 |
| **JBT0404** | Biotin-Ttds-FQSKKNVFVFGYFDRLRAKL-NH2 (SEQ ID NO: 974) | 3.38 | 14 |
| **JBT0405** | Biotin-FQSKKNVFVFGYFERLRAKL-NH2 (SEQ ID NO: 975) | | 15 |
| **JBT0406** | Ac-Ttds-FQSKKNVFVFGYFERLRAKL-NH2 (SEQ ID NO: 268) | | 9 |
| **JBT0471** | Ac-FQSKGNVFVTGYFERLRAKL-NH2 (SEQ ID NO: 26) | | 32 |
| **JBT0472** | Ac-FQSKGNVFVNGYFERLRAKL-NH2 (SEQ ID NO: 27) | | 22 |
| **JBT0473** | Ac-FQSKGNVFVHGYFERLRAKL-NH2 (SEQ ID NO: 28) | | 24 |
| **JBT0474** | Ac-FQSKGNVFVKGYFERLRAKL-NH2 (SEQ ID NO: 29) | | 33 |
| **JBT0475** | Ac-FQSKGNVFVEGYFERLRAKL-NH2 (SEQ ID NO: 30) | | 30 |
| **JBT0476** | Ac-FQSKGNVFVDGYFDRLRAKL-NH2 (SEQ ID NO: 31) | | 33 |
| **JBT0477** | Ac-FQSKGNVFVDGYFERLRAKL-NH2 (SEQ ID NO: 32) | 2.22 | 36 |
| **JBT0478** | Ac-FQSKDNVFVTGYFERLRAKL-NH2 (SEQ ID NO: 33) | | 19 |
| **JBT0479** | Ac-FQSKDNVFVNGYFERLRAKL-NH2 (SEQ ID NO: 34) | | 18 |
| **JBT0480** | Ac-FQSKDNVFVHGYFERLRAKL-NH2 (SEQ ID NO: 35) | | 16 |
| **JBT0481** | Ac-FQSKDNVFVKGYFERLRAKL-NH2 (SEQ ID NO: 36) | | 15 |
| **JBT0482** | Ac-FQSKDNVFVEGYFERLRAKL-NH2 (SEQ ID NO: 37) | | 23 |
| **JBT0483** | Ac-FQSKDNVFVDGYFERLRAKL-NH2 (SEQ ID NO: 38) | | 24 |
| **JBT0484** | Ac-FQSKDNVFVDGYFDRLRAKL-NH2 (SEQ ID NO: 976) | 4.89 | 19 |
| **JBT0485** | Ac-FQSKNNVFVTGYFERLRAKL-NH2 (SEQ ID NO: 39) | | 21 |
| **JBT0486** | Ac-FQSKNNVFVNGYFERLRAKL-NH2 (SEQ ID NO: 40) | | 19 |

FIGURE 25H

| | | | |
|---|---|---|---|
| **JBT0487** | Ac-FQSKNNVFVHGYFERLRAKL-NH2 (SEQ ID NO: 41) | | 19 |
| **JBT0488** | Ac-FQSKNNVFVKGYFERLRAKL-NH2 (SEQ ID NO: 42) | | 18 |
| **JBT0489** | Ac-FQSKNNVFVEGYFERLRAKL-NH2 (SEQ ID NO: 43) | | 21 |
| **JBT0490** | Ac-FQSKQNVFVTGYFERLRAKL-NH2 (SEQ ID NO: 44) | | 9 |
| **JBT0491** | Ac-FQSKQNVFVNGYFERLRAKL-NH2 (SEQ ID NO: 197) | | 10 |
| **JBT0492** | Ac-FQSKQNVFVHGYFERLRAKL-NH2 (SEQ ID NO: 198) | | 7 |
| **JBT0493** | Ac-FQSKQNVFVKGYFERLRAKL-NH2 (SEQ ID NO: 199) | | 7 |
| **JBT0494** | Ac-FQSKQNVFVDGYFERLRAKL-NH2 (SEQ ID NO: 45) | | 15 |
| **JBT0495** | Ac-FQSKQNVFVEGYFERLRAKL-NH2 (SEQ ID NO: 200) | | 15 |
| **JBT0497** | Ac-NmetPhe-QSKGNVFVFGYFERLRAKL-NH2 (SEQ ID NO: 201) | 1.13 | 15 |
| **JBT0498** | Ac-FQ-NmetSer-KGNVFVFGYFERLRAKL-NH2 (SEQ ID NO: 675) | | 9 |
| **JBT0499** | Ac-FQS-NmetLys-GNVFVFGYFERLRAKL-NH2 (SEQ ID NO: 202) | | 11 |
| **JBT0500** | Ac-FQSK-NmetGly-NVFVFGYFERLRAKL-NH2 (SEQ ID NO: 46) | 1.11 | 45 |
| **JBT0501** | Ac-FQSKGN-NmetV-FVFGYFERLRAKL-NH2 (SEQ ID NO: 417) | | 0 |
| **JBT0502** | Ac-FQSKGNV-NmetPhe-VFGYFERLRAKL-NH2 (SEQ ID NO: 751) | | 1 |
| **JBT0503** | Ac-FQSKGNVF-NmetV-FGYFERLRAKL-NH2 (SEQ ID NO: 676) | | 0 |
| **JBT0504** | Ac-FQSKGNVFV-NmetPhe-GYFERLRAKL-NH2 (SEQ ID NO: 418) | | 5 |
| **JBT0505** | Ac-FQSKGNVFVF-NmetGly-YFERLRAKL-NH2 (SEQ ID NO: 269) | | 9 |
| **JBT0506** | Ac-FQSKGNVFVFG-NmetTyr-FERLRAKL-NH2 (SEQ ID NO: 714) | | 0 |
| **JBT0507** | Ac-FQSKGNVFVFGY-NmetPhe-ERLRAKL-NH2 (SEQ ID NO: 677) | | 0 |
| **JBT0508** | Ac-FQSKGNVFVFGYF-NmetGlu-RLRAKL-NH2 (SEQ ID NO: 678) | | 2 |
| **JBT0509** | Ac-FQSKGNVFVFGYFE-Nmr-LRAKL-NH2 (SEQ ID NO: 752) | | 2 |
| **JBT0510** | Ac-FQSKGNVFVFGYFER-NmetLeu-RAKL-NH2 (SEQ ID NO: 753) | | 3 |
| **JBT0511** | Ac-FQSKGNVFVFGYFERL-Nmr-AKL-NH2 (SEQ ID NO: 754) | | 7 |
| **JBT0512** | Ac-FQSKGNVFVFGYFERLR-NmetAla-KL-NH2 (SEQ ID NO: 679) | | 1 |
| **JBT0513** | Ac-FQSKGNVFVFGYFERLRA-NmetLys-L-NH2 (SEQ ID NO: 755) | | 3 |

FIGURE 25I

| | | | |
|---|---|---|---|
| **JBT0514** | Ac-FQSKGNVFVFGYFERLRAK-NmetLeu-NH2 (SEQ ID NO: 419) | | 5 |
| **JBT0515** | Ac-bHomoPhe-QSKGNVFVFGYFERLRAKL-NH2 (SEQ ID NO: 420) | | 0 |
| **JBT0516** | Ac-F-bHomoGln-SKGNVFVFGYFERLRAKL-NH2 (SEQ ID NO: 680) | | 0 |
| **JBT0517** | Ac-FQ-bHomoSer-KGNVFVFGYFERLRAKL-NH2 (SEQ ID NO: 421) | | 0 |
| **JBT0518** | Ac-FQS-bHomoLys-GNVFVFGYFERLRAKL-NH2 (SEQ ID NO: 422) | | 0 |
| **JBT0519** | Ac-FQSK-bAla-NVFVFGYFERLRAKL-NH2 (SEQ ID NO: 270) | | 0 |
| **JBT0520** | Ac-FQSKG-bGln-VFVFGYFERLRAKL-NH2 (SEQ ID NO: 271) | | 0 |
| **JBT0521** | Ac-FQSKGN-bLeu-FVFGYFERLRAKL-NH2 (SEQ ID NO: 756) | | 0 |
| **JBT0522** | Ac-FQSKGNV-bHomoPhe-VFGYFERLRAKL-NH2 (SEQ ID NO: 681) | | 0 |
| **JBT0523** | Ac-FQSKGNVF-bLeu-FGYFERLRAKL-NH2 (SEQ ID NO: 757) | | 0 |
| **JBT0524** | Ac-FQSKGNVFV-bHomoPhe-GYFERLRAKL-NH2 (SEQ ID NO: 682) | | 0 |
| **JBT0525** | Ac-FQSKGNVFVF-bAla-YFERLRAKL-NH2 (SEQ ID NO: 758) | | 0 |
| **JBT0526** | Ac-FQSKGNVFVFG-bHomoTyr-FERLRAKL-NH2 (SEQ ID NO: 759) | | 0 |
| **JBT0527** | Ac-FQSKGNVFVFGY-bHomoPhe-ERLRAKL-NH2 (SEQ ID NO: 683) | | 0 |
| **JBT0528** | Ac-FQSKGNVFVFGYF-bE-RLRAKL-NH2 (SEQ ID NO: 272) | | 8 |
| **JBT0529** | Ac-FQSKGNVFVFGYFE-bHomoArg-LRAKL-NH2 (SEQ ID NO: 760) | | 0 |
| **JBT0530** | Ac-FQSKGNVFVFGYFER-Btl-RAKL-NH2 (SEQ ID NO: 684) | | 0 |
| **JBT0531** | Ac-FQSKGNVFVFGYFERL-bHomoArg-AKL-NH2 (SEQ ID NO: 203) | | 0 |
| **JBT0532** | Ac-FQSKGNVFVFGYFERLR-bAla-KL-NH2 (SEQ ID NO: 423) | | 0 |
| **JBT0533** | Ac-FQSKGNVFVFGYFERLRA-bHomoK-L-NH2 (SEQ ID NO: 424) | | 0 |
| **JBT0534** | Ac-FQSKGNVFVFGYFERLRAK-Btl-NH2 (SEQ ID NO: 204) | | 8 |
| **JBT0535** | Ac-FQSKGNVFVFGYFE-Cit-LRAKL-NH2 (SEQ ID NO: 685) | | 1 |
| **JBT0536** | Ac-FQSKGNVFVFGYFERL-Cit-AKL-NH2 (SEQ ID NO: 273) | | 11 |
| **JBT0537** | Ac-FQSKGNVFVFGYFE-Nle-LRAKL-NH2 (SEQ ID NO: 761) | | 7 |
| **JBT0538** | Ac-FQSKGNVFVFGYFERL-Nle-AKL-NH2 (SEQ ID NO: 425) | | 15 |
| **JBT0564** | Ac-FQSKKNVFVFGYFKRLRAKL-NH2 (SEQ ID NO: 205) | | 0 |

FIGURE 25J

| | | | |
|---|---|---|---|
| **JBT0578** | Ac-FQSKKNVFVFGYFFRLRAKL-NH2 (SEQ ID NO: 441) | | 0 |
| **JBT0613** | Ac-FQSKGNVFVFGYFERLRAKL-OH (SEQ ID NO: 283) | | 6 |
| **JBT0614** | NH2-FQSKGNVFVFGYFERLRAKL-OH (SEQ ID NO: 720) | | 4 |
| **JBT0615** | NH2-FQSKGNVFVFGYFERLRAKL-NH2 (SEQ ID NO: 284) | | 6 |
| **JBT0651** | Ac-FQSKGNVHVKGYFERLRAKL-NH2 (SEQ ID NO: 48) | | 6 |
| **JBT0652** | Ac-FQSKGNVHVDGYFERLRAKL-NH2 (SEQ ID NO: 49) | | 8 |
| **JBT0653** | Ac-FQSPGNVHVKGYFERLRAKL-NH2 (SEQ ID NO: 50) | | 9 |
| **JBT0654** | Ac-FQSPGNVHVDGYFERLRAKL-NH2 (SEQ ID NO: 51) | | 11 |
| **JBT0655** | Ac-FQSKGNIFVFGYFERLRAKL-NH2 (SEQ ID NO: 52) | | 9 |
| **JBT0656** | Ac-FQSKGNLFVFGYFERLRAKL-NH2 (SEQ ID NO: 286) | | 5 |
| **JBT0657** | Ac-FQSKGNVFIFGYFERLRAKL-NH2 (SEQ ID NO: 287) | | 8 |
| **JBT0658** | Ac-FQSKGNVFLFGYFERLRAKL-NH2 (SEQ ID NO: 694) | | 3 |
| **JBT0663** | Ac-FQSKaNVFVFGYFERLRAKL-NH2 (SEQ ID NO: 53) | | 22 |
| **JBT0668** | Ac-FQSKaNVFVTGYFARLRAKL-NH2 (SEQ ID NO: 54) | | 16 |
| **JBT0681** | Ac-FQSK-Nmg-AVFVFGYFARLRAKL-NH2 (SEQ ID NO: 206) | | 25 |
| **JBT0683** | Ac-FQSK-Nmg-AVFVDGYFARLRAKL-NH2 (SEQ ID NO: 55) | | 38 |
| **JBT0708** | Ac-FQSKaNVFVAGYFERLRAKL-NH2 (SEQ ID NO: 59) | | 25 |
| **JBT0714** | Ac-FQSKaAVFVDGYFARLRAKL-NH2 (SEQ ID NO: 60) | | 29 |
| **JBT0717** | Ac-FQSK-Nmg-NVFVDGYFERLRAKL-NH2 (SEQ ID NO: 61) | | 50 |
| **JBT0720** | Ac-FQSK-Nmg-NVFVTGYFARLRAKL-NH2 (SEQ ID NO: 62) | | 30 |
| **JBT0740** | Ac-FQSKGNVFVDGYFERL-Aib-AKL-NH2 (SEQ ID NO: 66) | | 36 |
| **JBT0754** | Ac-FQSK-Nmg-AVFVTGYFARLRAKL-NH2 (SEQ ID NO: 67) | | 27 |
| **JBT0765** | Ac-FQSKGNVFVDGYFERL-Eew-AKL-NH2 (SEQ ID NO: 68) | | 37 |
| **JBT0780** | Ac-FQSK-Nmg-NVFVFGYFARLRAKL-NH2 (SEQ ID NO: 70) | 1.92 | 35 |
| **JBT0789** | Ac-FQSK-Nmg-NVFVDGYFERL-Nle-AKL-NH2 (SEQ ID NO: 71) | 0.79 | 51 |
| **JBT0806** | Ac-FQSK-Nmg-NVFVAGYFARLRAKL-NH2 (SEQ ID NO: 74) | 2.42 | 38 |

FIGURE 25K

| | | | |
|---|---|---|---|
| **JBT0837** | Ac-FQSK-Nmg-NVFVTGYFERL-Nle-AKL-NH2 (SEQ ID NO: 213) | | 33 |
| **JBT0844** | Ac-FQSKaNVFVDGYFERLRAKL-NH2 (SEQ ID NO: 300) | | 23 |
| **JBT0850** | Ac-FQSKaAVFVAGYFARLRAKL-NH2 (SEQ ID NO: 302) | | 24 |
| **JBT0854** | Ac-FQSKaAVFVAGYFARL-Nle-AKL-NH2 (SEQ ID NO: 490) | | 14 |
| **JBT0870** | Ac-FQSKaAVFVTGYFARLRAKL-NH2 (SEQ ID NO: 214) | | 20 |
| **JBT0886** | Ac-FQSKaNVFVDGYFARLRAKL-NH2 (SEQ ID NO: 215) | | 21 |
| **JBT0919** | Ac-FQSKaNVFVTGYFERLRAKL-NH2 (SEQ ID NO: 79) | | 24 |
| **JBT0931** | Ac-FQSKGNVFVDGYFERL-Eag-AKL-NH2 (SEQ ID NO: 82) | | 24 |
| **JBT0946** | Ac-FQSKGNVFVDGYFERL-Dab-AKL-NH2 (SEQ ID NO: 85) | | 29 |
| **JBT0950** | Ac-FQSKaNVFVFGYFARLRAKL-NH2 (SEQ ID NO: 217) | | 14 |
| **JBT0973** | Ac-FQSKGNVFVDGYFERL-Cha-AKL-NH2 (SEQ ID NO: 92) | 1.21 | 32 |
| **JBT1006** | Ac-FQSKGNVFVDGYFERL-Hle-AKL-NH2 (SEQ ID NO: 96) | 1.35 | 35 |
| **JBT1035** | Ac-FQSK-Nmg-AVFVAGYFARL-Nle-AKL-NH2 (SEQ ID NO: 218) | | 25 |
| **JBT1037** | Ac-FQSKGNVFVDGYFERL-Nle-AKL-NH2 (SEQ ID NO: 104) | | 30 |
| **JBT1043** | Ac-FQSKaNVFVDGYFERL-Nle-AKL-NH2 (SEQ ID NO: 106) | | 27 |
| **JBT1082** | Ac-FQSKaAVFVFGYFARLRAKL-NH2 (SEQ ID NO: 565) | | 16 |
| **JBT1084** | Ac-FQSK-Nmg-AVFVAGYFARLRAKL-NH2 (SEQ ID NO: 109) | | 28 |
| **JBT1122** | Ac-FQSK-Nmg-NVFVDGYFARL-Nle-AKL-NH2 (SEQ ID NO: 113) | 0.81 | 43 |
| **JBT1133** | Ac-FQSKkAVFVDGYFARLRAKL-NH2(SEQ ID NO: 115) | | 31 |
| **JBT1134** | Ac-FQSKGAVFVDGYFARLRAKL-NH2 (SEQ ID NO: 116) | | 28 |
| **JBT1135** | Ac-FQSKDAVFVDGYFARLRAKL-NH2 (SEQ ID NO: 221) | | 22 |
| **JBT1136** | Ac-FQSKdAVFVDGYFARLRAKL-NH2 (SEQ ID NO: 117) | | 36 |
| **JBT1137** | Ac-FQSKkAVFVAGYFARLRAKL-NH2 (SEQ ID NO: 118) | | 23 |
| **JBT1138** | Ac-FQSKGAVFVAGYFARLRAKL-NH2 (SEQ ID NO: 222) | | 19 |
| **JBT1139** | Ac-FQSKDAVFVAGYFARLRAKL-NH2 (SEQ ID NO: 223) | | 16 |
| **JBT1140** | Ac-FQSKdAVFVAGYFARLRAKL-NH2 (SEQ ID NO: 119) | | 29 |

FIGURE 25L

| | | | |
|---|---|---|---|
| **JBT1141** | Ac-FQSKkAVFVKGYFARLRAKL-NH2 (SEQ ID NO: 120) | | 13 |
| **JBT1142** | Ac-FQSKGAVFVKGYFARLRAKL-NH2 (SEQ ID NO: 224) | | 11 |
| **JBT1143** | Ac-FQSKDAVFVKGYFARLRAKL-NH2 (SEQ ID NO: 225) | | 6 |
| **JBT1144** | Ac-FQSKdAVFVKGYFARLRAKL-NH2 (SEQ ID NO: 121) | | 15 |
| **JBT1145** | Ac-FQSKkAVFVTGYFARLRAKL-NH2 (SEQ ID NO: 122) | | 13 |
| **JBT1146** | Ac-FQSKGAVFVTGYFARLRAKL-NH2 (SEQ ID NO: 226) | | 12 |
| **JBT1147** | Ac-FQSKDAVFVTGYFARLRAKL-NH2 (SEQ ID NO: 227) | | 14 |
| **JBT1148** | Ac-FQSKdAVFVTGYFARLRAKL-NH2 (SEQ ID NO: 123) | | 27 |
| **JBT1149** | Ac-FQSKGNVFvFGYFERLRAKL-NH2 (SEQ ID NO: 936) | | 0 |
| **JBT1151** | Ac-FQSKKNVFVFGYFERLRAKD-NH2 (SEQ ID NO: 937) | | 0 |
| **JBT1152** | Ac-FQSKKNVFFFGYFERLRAKL-NH2 (SEQ ID NO: 735) | | 0 |
| **JBT1153** | Ac-FQSKKNVFVFGYFERLGAKL-NH2 (SEQ ID NO: 705) | | 4 |
| **JBT1155** | Ac-FQSK-Nmg-NVFVTGYFERLRAKL-NH2 (SEQ ID NO: 125) | | 32 |
| **JBT1156** | Ac-FQSKaNVFVDGYFARL-Nle-AKL-NH2 (SEQ ID NO: 126) | | 22 |
| **JBT1157** | Ac-FQSKaNVFVAGYFARLRAKL-NH2 (SEQ ID NO: 127) | | 22 |
| **JBT1162** | Ac-FQSKpNVFVFGYFERLRAKL-NH2 (SEQ ID NO: 129) | | 51 |
| **JBT1396** | Ac-FQSK-Nmg-NVFVAGYFERLRAKL-NH2 (SEQ ID NO: 161) | | 34 |
| **JBT1584** | Ac-FQSK-Nmg-NVFVDGYFERL-Aib-AKL-NH2 (SEQ ID NO: 164) | | 57 |
| **JBT1585** | Ac-FQSK-Nmg-NVFVTGYFERL-Aib-AKL-NH2 (SEQ ID NO: 165) | | 48 |
| **JBT1590** | Ac-FQSKGNVFV[CGYFERL-Aib-AKLC]-NH2 (SEQ ID NO: 401) | | 22 |
| **JBT1591** | Ac-FQSKGNVFVDGYF[CRL-Aib-AKLC]-NH2 (SEQ ID NO: 168) | | 23 |
| **JBT1592** | Ac-[CFQSKGNVFVDGYFERLC]AKL-NH2 (SEQ ID NO: 402) | | 11 |
| **JBT1593** | Ac-FQSK[CNVFVDGYFERLC]AKL-NH2 (SEQ ID NO: 670) | | 13 |
| **JBT1594** | Ac-FQSKGNVFV[CGYFERLC]AKL-NH2 (SEQ ID NO: 671) | | 5 |
| **JBT1595** | Ac-[CFQSKGNVFVC]GYFERL-Aib-AKL-NH2 (SEQ ID NO: 403) | | 12 |
| **JBT1596** | Ac-[CFQSKGC]VFVEGYFERL-Aib-AKL-NH2 (SEQ ID NO: 404) | | 13 |

FIGURE 25M

| | | | |
|---|---|---|---|
| **JBT1843** | Ac-FQSKGNIFVDGYFERLHAKL-NH2 (SEQ ID NO: 169) | | 7 |
| **JBT1844** | Ac-FQSKNNVFVDGYFKRLRAKL-NH2 (SEQ ID NO: 170) | | 6 |
| **JBT1845** | Ac-FQSYKHVFVDGYFERLRAKL-NH2 (SEQ ID NO: 249) | | 6 |
| **JBT1846** | Ac-FQSKGIVFVDGYFKRLRAKL-NH2 (SEQ ID NO: 250) | | 7 |
| **JBT1847** | Ac-YQTKGNVFVDGYFERLRAKL-NH2 (SEQ ID NO: 171) | | 16 |
| **JBT1853** | PEG(40kD)-FQSKGNVFVDGYFERL-Aib-AKL-NH2 (SEQ ID NO: 175) | | 56 |
| **JBT1855** | Ac-FQSKGNVFVDGYFERL-Aib-AKLC(PEG40kD)-NH2 (SEQ ID NO: 252) | | 59 |

FIGURE 26A

| **JBT0120 class** | | **Extrinsic Tenase Inhibition assay** | |
|---|---|---|---|
| | | | |
| **Peptide** | **Sequence** | **EC50 (µM)** | **% Inhibition @ 2.5µM** |
| **JBT0120** | Ac-SGASRYKWF[CGMRDMKGTMSC]VWVKFRYDTS-NH2 (SEQ ID NO: 1047) | 0.88 | 45 |
| **JBT0124** | Biotin-Ttds-SGASRYKWFCGMRDMKGTMSCVWVKFRYDTS-NH2 (SEQ ID NO: 1290) | 1.26 | 36 |
| **JBT0247** | Ac-SGASRYKWFCGMRDMKGTMSCVWVKFRYDTS-NH2 (SEQ ID NO: 1213) | 0.61 | 42 |
| **JBT0248** | Ac-KKSGASRYKWF[CGMRDMKGTMSC]VWVKFRYDTSKK-NH2 (SEQ ID NO: 1001) | 0.27 | 52 |
| **JBT0249** | Ac-KKSGASRYKWFCGMRDMKGTMSKK-NH2 (SEQ ID NO: 1214) | 1.06 | 16 |
| **JBT0250** | Ac-KKSRYKWF[CGMRDMKGTMSC]VWKK-NH2 (SEQ ID NO: 1201) | 0.61 | 19 |
| **JBT0251** | Ac-KKKWF[CGMRDMKGTMSC]VWVKFKK-NH2 (SEQ ID NO: 1202) | 0.63 | 23 |
| **JBT0252** | Ac-KK[CGMRDMKGTMSC]VWVKFRYDKK-NH2 (SEQ ID NO: 1215) | 1.02 | 18 |
| **JBT0253** | Ac-KKMRDMKGTMSCVWVKFRYDTSKK-NH2 (SEQ ID NO: 1216) | 0.55 | 23 |
| **JBT0319** | Ac-SGASRYKWF[CGMRDMKGTMSC]VWVKFRY-NH2 (SEQ ID NO: 1002) | | 60 |
| **JBT0320** | Ac-SGASRYKWF[CGMRDMKGTMSC]VWVK-NH2 (SEQ ID NO: 1103) | 6.40 | 7 |
| **JBT0321** | Ac-SGASRYKWF[CGMRDMKGTMSC]V-NH2 (SEQ ID NO: 1217) | | 1 |
| **JBT0322** | Ac-SGASRYKWFCGMRDMKGTM-NH2 (SEQ ID NO: 1218) | | 3 |
| **JBT0323** | Ac-SRYKWF[CGMRDMKGTMSC]VWVKFRYDTS-NH2 (SEQ ID NO: 1076) | 0.77 | 48 |
| **JBT0324** | Ac-KWF[CGMRDMKGTMSC]VWVKFRYDTS-NH2 (SEQ ID NO: 1155) | 2.44 | 18 |
| **JBT0325** | Ac-[CGMRDMKGTMSC]VWVKFRYDTS-NH2 (SEQ ID NO: 1219) | | 4 |
| **JBT0326** | Ac-RDMKGTMSCVWVKFRYDTS-NH2 (SEQ ID NO: 1220) | | 3 |
| **JBT0327** | Ac-SGASRYKWFCGMRDMKGTMS-NH2 (SEQ ID NO: 1222) | | 0 |
| **JBT0328** | Ac-SRYKWF[CGMRDMKGTMSC]VW-NH2 (SEQ ID NO: 1223) | | 1 |
| **JBT0329** | Ac-KWF[CGMRDMKGTMSC]VWVKF-NH2 (SEQ ID NO: 1156) | | 8 |
| **JBT0330** | Ac-[CGMRDMKGTMSC]VWVKFRYD-NH2 (SEQ ID NO: 1224) | | 7 |

FIGURE 26B

| | | | |
|---|---|---|---|
| **JBT0331** | Ac-MRDMKGTMSCVWVKFRYDTS-NH2 (SEQ ID NO: 1225) | | 5 |
| **JBT0332** | Ac-SRYKWFCGMRDMKGTMSCVW-NH2 (SEQ ID NO: 1206) | | 5 |
| **JBT0333** | Ac-KWFCGMRDMKGTMSCVWVKF-NH2 (SEQ ID NO: 1207) | | 11 |
| **JBT0334** | Ac-CGMRDMKGTMSCVWVKFRYD-NH2 (SEQ ID NO: 1227) | | 3 |
| **JBT0409** | Ac-SGASRYKWFSGMRDMKGTMSSVWVKFRYDTS-NH2 (SEQ ID NO: 1204) | | 5 |
| **JBT0410** | Ac-SGASRYKWFSG-Nle-RD-Nle-KGT-Nle-SSVWVKFRYDTS-NH2 (SEQ ID NO: 1208) | | 7 |
| **JBT0411** | Ac-SGASRYKWF[CG-Nle-RD-Nle-KGT-Nle-SC]VWVKFRYDTS-NH2 (SEQ ID NO: 1104) | | 24 |
| **JBT0412** | Ac-KWF[CG-Nle-RD-Nle-KGT-Nle-SC]VWVKF-NH2 (SEQ ID NO: 1209) | | 12 |
| **JBT0413** | Ac-KWFSGMRDMKGTMSSVWVKF-NH2 (SEQ ID NO: 1228) | | 2 |
| **JBT0414** | Ac-KWFSG-Nle-RD-Nle-KGT-Nle-SSVWVKF-NH2 (SEQ ID NO: 1205) | | 8 |
| **JBT0415** | Ac-SRYKWF[CGMRDMKGTMSC]VWVKF-NH2 (SEQ ID NO: 1003) | 0.19 | 52 |
| **JBT0416** | Ac-SRYKWF[CG-Nle-RD-Nle-KGT-Nle-SC]VWVKF-NH2 (SEQ ID NO: 1077) | | 46 |
| **JBT0417** | Ac-SRYKWFSGMRDMKGTMSSVWVKF-NH2 (SEQ ID NO: 1229) | | 11 |
| **JBT0418** | Ac-SRYKWFSG-Nle-RD-Nle-KGT-Nle-SSVWVKF-NH2 (SEQ ID NO: 1210) | | 11 |
| **JBT0419** | Ac-SGGRKHKHFLRSNGKPSRALSSMHFWRWSTS-NH2 (SEQ ID NO: 1293) | | 7 |
| **JBT0435*** | Ac-RKRDVSGKM[CWSGFGSKWFRC]ADMMTYYSVT-NH2 (SEQ ID NO: 1211) | | 5 |
| **JBT0436*** | Ac-RWSGKSTYS[CDAMVRRMGMKC]FSFGWTDVYK-NH2 (SEQ ID NO: 1212) | | 0 |
| **JBT0437** | Ac-ARYKWF[CGMRDMKGTMSC]VWVKF-NH2 (SEQ ID NO: 1048) | | 52 |
| **JBT0438** | Ac-SAYKWF[CGMRDMKGTMSC]VWVKF-NH2 (SEQ ID NO: 1078) | | 46 |
| **JBT0439** | Ac-SRAKWF[CGMRDMKGTMSC]VWVKF-NH2 (SEQ ID NO: 1105) | | 38 |
| **JBT0440** | Ac-SRYAWF[CGMRDMKGTMSC]VWVKF-NH2 (SEQ ID NO: 1106) | | 34 |
| **JBT0441** | Ac-SRYKAF[CGMRDMKGTMSC]VWVKF-NH2 (SEQ ID NO: 1230) | | 1 |
| **JBT0442** | Ac-SRYKWA[CGMRDMKGTMSC]VWVKF-NH2 (SEQ ID NO: 1231) | | 17 |
| **JBT0443** | Ac-SRYKWFAGMRDMKGTMSCVWVKF-NH2 (SEQ ID NO: 1157) | | 7 |
| **JBT0444** | Ac-SRYKWF[CAMRDMKGTMSC]VWVKF-NH2 (SEQ ID NO: 1004) | | 63 |
| **JBT0445** | Ac-SRYKWF[CGARDMKGTMSC]VWVKF-NH2 (SEQ ID NO: 1107) | | 12 |
| **JBT0446** | Ac-SRYKWF[CGMADMKGTMSC]VWVKF-NH2 (SEQ ID NO: 1079) | | 46 |
| **JBT0447** | Ac-SRYKWF[CGMRAMKGTMSC]VWVKF-NH2 (SEQ ID NO: 1158) | | 15 |
| **JBT0448** | Ac-SRYKWF[CGMRDAKGTMSC]VWVKF-NH2 (SEQ ID NO: 1108) | | 33 |

FIGURE 26C

| | | | |
|---|---|---|---|
| **JBT0449** | Ac-SRYKWF[CGMRDMAGTMSC]VWVKF-NH2 (SEQ ID NO: 1080) | | 55 |
| **JBT0450** | Ac-SRYKWF[CGMRDMKATMSC]VWVKF-NH2 (SEQ ID NO: 1159) | | 34 |
| **JBT0451** | Ac-SRYKWF[CGMRDMKGAMSC]VWVKF-NH2 (SEQ ID NO: 1081) | | 46 |
| **JBT0452** | Ac-SRYKWF[CGMRDMKGTASC]VWVKF-NH2 (SEQ ID NO: 1109) | | 31 |
| **JBT0453** | Ac-SRYKWF[CGMRDMKGTMAC]VWVKF-NH2 (SEQ ID NO: 1110) | 0.97 | 40 |
| **JBT0454** | Ac-SRYKWFCGMRDMKGTMSAVWVKF-NH2 (SEQ ID NO: 1160) | | 0 |
| **JBT0455** | Ac-SRYKWF[CGMRDMKGTMSC]AWVKF-NH2 (SEQ ID NO: 1049) | 0.95 | 30 |
| **JBT0456** | Ac-SRYKWFCGMRDMKGTMSCVAVKF-NH2 (SEQ ID NO: 1232) | | 0 |
| **JBT0457** | Ac-SRYKWF[CGMRDMKGTMSC]VWAKF-NH2 (SEQ ID NO: 1161) | | 17 |
| **JBT0458** | Ac-SRYKWF[CGMRDMKGTMSC]VWVAF-NH2 (SEQ ID NO: 1082) | | 52 |
| **JBT0459** | Ac-SRYKWF[CGMRDMKGTMSC]VWVKA-NH2 (SEQ ID NO: 1083) | | 38 |
| **JBT0460** | Ac-RYKWF[CGMRDMKGTMSC]VWVKF-NH2 (SEQ ID NO: 1050) | | 51 |
| **JBT0461** | Ac-YKWF[CGMRDMKGTMSC]VWVKF-NH2 (SEQ ID NO: 1111) | | 40 |
| **JBT0462** | Ac-SRYKWFGM[CRDMKGTMSC]VWVKF-NH2 (SEQ ID NO: 1233) | | 0 |
| **JBT0463** | Ac-SRYKWFGMRD[CMKGTMSC]VWVKF-NH2 (SEQ ID NO: 1234) | | 11 |
| **JBT0464** | Ac-SRYKWFGMRDMK[CGTMSC]VWVKF-NH2 (SEQ ID NO: 1235) | | 10 |
| **JBT0465** | Ac-SRYKWF[CGMRDMKGTC]MSVWVKF-NH2 (SEQ ID NO: 1236) | | 7 |
| **JBT0466** | Ac-SRYKWF[CGMRDMKC]GTMSVWVKF-NH2 (SEQ ID NO: 1237) | | 11 |
| **JBT0467** | Ac-SRYKWF[CGMRDC]MKGTMSVWVKF-NH2 (SEQ ID NO: 1238) | | 11 |
| **JBT0468** | Ac-SRYKWFG[CMRDMKGTMC]SVWVKF-NH2 (SEQ ID NO: 1239) | | 7 |
| **JBT0469** | Ac-SRYKWFGM[CRDMKGTC]MSVWVKF-NH2 (SEQ ID NO: 1240) | | 11 |
| **JBT0470** | Ac-SRYKWFGMR[CDMKGC]TMSVWVKF-NH2 (SEQ ID NO: 1162) | | 2 |
| **JBT0617** | Ac-SRYKWF[homoC-GMRDMKGTMSC]VWVKF-NH2 (SEQ ID NO: 1112) | | 21 |
| **JBT0618** | Ac-SRYKWF[CGMRDMKGTMS-homoC]VWVKF-NH2 (SEQ ID NO: 1163) | | 11 |
| **JBT0619** | Ac-SRYKWF[homoC-GMRDMKGTMS-homoC]VWVKF-NH2 (SEQ ID NO: 1241) | | 1 |
| **JBT0620** | Ac-SRYKWF[Dap-GMRDMKGTMS-D]VWVKF-NH2 (SEQ ID NO: 1242) | | 0 |
| **JBT0625** | Ac-SRYKWF[CMRDMKGTMSC]VWVKF-NH2 (SEQ ID NO: 1244) | | 0 |
| **JBT0626** | Ac-SRYKWF[CGMRDKGTMSC]VWVKF-NH2 (SEQ ID NO: 1164) | | 7 |
| **JBT0627** | Ac-SRYKWF[CGMRDMGTMSC]VWVKF-NH2 (SEQ ID NO: 1165) | | 3 |

FIGURE 26D

| | | | |
|---|---|---|---|
| **JBT0628** | Ac-SRYKWF[CGMRDMKGMSC]VWVKF-NH2 (SEQ ID NO: 1166) | | 0 |
| **JBT0629** | Ac-SRYKWF[cGMRDMKGTMSC]VWVKF-NH2 (SEQ ID NO: 1167) | | 3 |
| **JBT0631** | Ac-SRYKWF[CGmRDMKGTMSC]VWVKF-NH2 (SEQ ID NO: 1113) | | 18 |
| **JBT0632** | Ac-SRYKWF[CGMrDMKGTMSC]VWVKF-NH2 (SEQ ID NO: 1245) | | 0 |
| **JBT0633** | Ac-SRYKWF[CGMRdMKGTMSC]VWVKF-NH2 (SEQ ID NO: 1168) | | 2 |
| **JBT0634** | Ac-SRYKWF[CGMRDmKGTMSC]VWVKF-NH2 (SEQ ID NO: 1051) | 0.47 | 44 |
| **JBT0635** | Ac-SRYKWF[CGMRDMkGTMSC]VWVKF-NH2 (SEQ ID NO: 1114) | | 10 |
| **JBT0637** | Ac-SRYKWF[CGMRDMKGtMSC]VWVKF-NH2 (SEQ ID NO: 1169) | | 0 |
| **JBT0638** | Ac-SRYKWF[CGMRDMKGTmSC]VWVKF-NH2 (SEQ ID NO: 1246) | | 0 |
| **JBT0639** | Ac-SRYKWF[CGMRDMKGTMsC]VWVKF-NH2 (SEQ ID NO: 1170) | | 3 |
| **JBT0640** | Ac-SRYKWF[CGMRDMKGTMSc]VWVKF-NH2 (SEQ ID NO: 1171) | | 1 |
| **JBT0641** | Ac-SRYKWF[CPMRDMKGTMSC]VWVKF-NH2 (SEQ ID NO: 1247) | | 0 |
| **JBT0642** | Ac-SRYKWF[CGPRDMKGTMSC]VWVKF-NH2 (SEQ ID NO: 1248) | | 0 |
| **JBT0643** | Ac-SRYKWF[CGMPDMKGTMSC]VWVKF-NH2 (SEQ ID NO: 1006) | | 31 |
| **JBT0644** | Ac-SRYKWF[CGMRPMKGTMSC]VWVKF-NH2 (SEQ ID NO: 1172) | | 17 |
| **JBT0645** | Ac-SRYKWF[CGMRDPKGTMSC]VWVKF-NH2 (SEQ ID NO: 1084) | | 23 |
| **JBT0646** | Ac-SRYKWF[CGMRDMPGTMSC]VWVKF-NH2 (SEQ ID NO: 1173) | | 2 |
| **JBT0647** | Ac-SRYKWF[CGMRDMKPTMSC]VWVKF-NH2 (SEQ ID NO: 1249) | | 0 |
| **JBT0648** | Ac-SRYKWF[CGMRDMKGPMSC]VWVKF-NH2 (SEQ ID NO: 1174) | | 3 |
| **JBT0649** | Ac-SRYKWF[CGMRDMKGTPSC]VWVKF-NH2 (SEQ ID NO: 1175) | | 2 |
| **JBT0650** | Ac-SRYKWF[CGMRDMKGTMPC]VWVKF-NH2 (SEQ ID NO: 1250) | | 0 |
| **JBT0787** | Ac-SRYKWF[CG-SeMet-RD-SeMet-KGT-SeMet-SC]VWVKF-NH2 (SEQ ID NO: 1292) | | 55 |
| **JBT1416** | Ac-DRYKWF[CGMRDMKGTMSC]VWVKF-NH2 (SEQ ID NO: 1007) | | 47 |
| **JBT1426** | Ac-SRYKWF[CGMRDMDGTMSC]VWVKF-NH2 (SEQ ID NO: 1008) | | 40 |
| **JBT1436** | Ac-FRYKWF[CGMRDMKGTMSC]VWVKF-NH2 (SEQ ID NO: 1053) | | 51 |
| **JBT1437** | Ac-SFYKWF[CGMRDMKGTMSC]VWVKF-NH2 (SEQ ID NO:1010) | | 53 |
| **JBT1438** | Ac-SRFKWF[CGMRDMKGTMSC]VWVKF-NH2 (SEQ ID NO: 1011) | | 49 |
| **JBT1445** | Ac-SRYKWF[CGMRDFKGTMSC]VWVKF-NH2 (SEQ ID NO: 1012) | | 39 |
| **JBT1446** | Ac-SRYKWF[CGMRDMFGTMSC]VWVKF-NH2 (SEQ ID NO: 1054) | | 46 |

FIGURE 26E

| | | | |
|---|---|---|---|
| **JBT1448** | Ac-SRYKWF[CGMRDMKGFMSC]VWVKF-NH2 (SEQ ID NO: 1123) | | 47 |
| **JBT1449** | Ac-SRYKWF[CGMRDMKGTFSC]VWVKF-NH2 (SEQ ID NO: 1013) | | 55 |
| **JBT1455** | Ac-GRYKWF[CGMRDMKGTMSC]VWVKF-NH2 (SEQ ID NO: 1014) | | 49 |
| **JBT1474** | Ac-KRYKWF[CGMRDMKGTMSC]VWVKF-NH2 (SEQ ID NO: 1016) | | 59 |
| **JBT1481** | Ac-SRYKWF[CGMKDMKGTMSC]VWVKF-NH2 (SEQ ID NO: 1017) | | 55 |
| **JBT1483** | Ac-SRYKWF[CGMRDKKGTMSC]VWVKF-NH2 (SEQ ID NO: 1057) | | 50 |
| **JBT1492** | Ac-LRYKWF[CGMRDMKGTMSC]VWVKF-NH2 (SEQ ID NO: 1018) | | 52 |
| **JBT1493** | Ac-SLYKWF[CGMRDMKGTMSC]VWVKF-NH2 (SEQ ID NO: 1060) | | 43 |
| **JBT1502** | Ac-SRYKWF[CGMRDLKGTMSC]VWVKF-NH2 (SEQ ID NO: 1019) | | 46 |
| **JBT1506** | Ac-SRYKWF[CGMRDMKGTLSC]VWVKF-NH2 (SEQ ID NO:1064) | | 45 |
| **JBT1512** | Ac-SRYKWF[CGMRDMKGTMSC]VWVKL-NH2 (SEQ ID NO: 1020) | | 44 |
| **JBT1541** | Ac-SRYKWF[CGMRDMKGTMSC]VWVPF-NH2 (SEQ ID NO: 1023) | | 41 |
| **JBT1544** | H-SRYKWF[CGMRDMKGTMSC]VWVKF-NH2 (SEQ ID NO: 1024) | | 59 |
| **JBT1570** | Ac-SRYKWF[CGMRDIKGTMSC]VWVKF-NH2 (SEQ ID NO: 1025) | | 41 |

FIGURE 27A

| **JBT0122 class** | | **Extrinsic Tenase Inhibition assay** | |
|---|---|---|---|
| | | | |
| **Peptide** | **Sequence** | **EC50 (μM)** | **% Inhibition @ 2.5μM** |
| **JBT0122** | Ac-SGYASFPLAVQLHVSKRSKEMALARLYYKTS-NH2 (SEQ ID NO: 2002) | 6.70 | 7 |
| **JBT0126** | Biotin-Ttds-SGYASFPLAVQLHVSKRSKEMALARLYYKTS-NH2 (SEQ ID NO: 2498) | 5.05 | 5 |
| **JBT0221** | Ac-KKSGYASFPLAVQLHVSKRSKEMALARLYYKTSKK-NH2 (SEQ ID NO: 2003) | 3.37 | 19 |
| **JBT0222** | Ac-MKSRSLGLAYFAKHSSLEVLQTRKVAAPYY-NH2 (SEQ ID NO: 2127) | | 4 |
| **JBT0223** | Ac-KMQLRVYASTAHSRYLLGSSLFPKYAEVKA-NH2 (SEQ ID NO: 2297) | | 4 |
| **JBT0224** | Ac-KKSGYASFPLAVQLHVSKRSKEMALARLYYKK-NH2 (SEQ ID NO: 2298) | 3.49 | 18 |
| **JBT0225** | Ac-KKSGYASFPLAVQLHVSKRSKEMALARKK-NH2 (SEQ ID NO: 2128) | | 0 |
| **JBT0226** | Ac-KKSGYASFPLAVQLHVSKRSKEMAKK-NH2 (SEQ ID NO: 2299) | | 0 |
| **JBT0227** | Ac-KKSGYASFPLAVQLHVSKRSKKK-NH2 (SEQ ID NO: 2300) | | 5 |
| **JBT0228** | Ac-KKASFPLAVQLHVSKRSKEMALARLYYKTSKK-NH2 (SEQ ID NO: 2016) | 6.93 | 9 |
| **JBT0229** | Ac-KKPLAVQLHVSKRSKEMALARLYYKTSKK-NH2 (SEQ ID NO: 2129) | | 0 |
| **JBT0230** | Ac-KKVQLHVSKRSKEMALARLYYKTSKK-NH2 (SEQ ID NO: 2301) | | 0 |
| **JBT0231** | Ac-KKHVSKRSKEMALARLYYKTSKK-NH2 (SEQ ID NO: 2302) | | 0 |
| **JBT0232** | Ac-KKGYASFPLAVQLHVSKRSKEMKK-NH2 (SEQ ID NO: 2303) | | 2 |
| **JBT0233** | Ac-KKYASFPLAVQLHVSKRSKEMAKK-NH2 (SEQ ID NO: 2304) | | 6 |
| **JBT0234** | Ac-KKVQLHVSKRSKEMALARLYYKKK-NH2 (SEQ ID NO: 2305) | | 3 |
| **JBT0235** | Ac-KKQLHVSKRSKEMALARLYYKTKK-NH2 (SEQ ID NO: 2306) | | 0 |
| **JBT0236** | Ac-KKLHVSKRSKEMALARLYYKTSKK-NH2 (SEQ ID NO: 2307) | | 0 |
| **JBT0237** | Ac-KKSGYASFPLAVQLHVSKRSKEKK-NH2 (SEQ ID NO: 2308) | | 2 |
| **JBT0359** | Ac-ASFPLAVQLHVSKRSKEMA-NH2 (SEQ ID NO: 2309) | | 6 |
| **JBT0360** | Ac-SFPLAVQLHVSKRSKEMA-NH2 (SEQ ID NO: 2310) | | 2 |

FIGURE 27B

| | | | |
|---|---|---|---|
| **JBT0361** | Ac-FPLAVQLHVSKRSKEMA-NH2 (SEQ ID NO: 2311) | | 9 |
| **JBT0362** | Ac-ASFPLAVQLHVSKRSKEM-NH2 (SEQ ID NO: 2312) | | 6 |
| **JBT0363** | Ac-ASFPLAVQLHVSKRSKE-NH2 (SEQ ID NO: 2313) | | 9 |
| **JBT0364** | Ac-ASFPLAVQLHVSKRSKEMAL-NH2 (SEQ ID NO: 2314) | | 12 |
| **JBT0365** | Ac-ASFPLAVQLHVSKRSKEMALA-NH2 (SEQ ID NO: 2315) | | 9 |
| **JBT0366** | Ac-ASFPLAVQLHVSKRSKEMALAR-NH2 (SEQ ID NO: 2316) | | 11 |
| **JBT0367** | Ac-ASFPLAVQLHVSKRSKEMALARL-NH2 (SEQ ID NO: 2317) | | 10 |
| **JBT0368** | Ac-ASFPLAVQLHVSKRSKEMALARLY-NH2 (SEQ ID NO: 2130) | | 8 |
| **JBT0369** | Ac-ASFPLAVQLHVSKRSKEMALARLYY-NH2 (SEQ ID NO: 2017) | | 9 |
| **JBT0370** | Ac-YASFPLAVQLHVSKRSKEMA-NH2 (SEQ ID NO: 2318) | | 0 |
| **JBT0371** | Ac-GYASFPLAVQLHVSKRSKEMA-NH2 (SEQ ID NO: 2319) | | 5 |
| **JBT0660** | Ac-AGYASFPLAVQLHVSKRSKEMALARLYYKTS-NH2 (SEQ ID NO: 2004) | | 0 |
| **JBT0661** | Ac-SAYASFPLAVQLHVSKRSKEMALARLYYKTS-NH2 (SEQ ID NO: 2005) | | 3 |
| **JBT0662** | Ac-SGAASFPLAVQLHVSKRSKEMALARLYYKTS-NH2 (SEQ ID NO: 2131) | | 0 |
| **JBT0664** | Ac-SGYAAFPLAVQLHVSKRSKEMALARLYYKTS-NH2 (SEQ ID NO: 2006) | | 3 |
| **JBT0665** | Ac-SGYASAPLAVQLHVSKRSKEMALARLYYKTS-NH2 (SEQ ID NO: 2132) | | 0 |
| **JBT0666** | Ac-SGYASFALAVQLHVSKRSKEMALARLYYKTS-NH2 (SEQ ID NO: 2001) | | 5 |
| **JBT0667** | Ac-SGYASFPAAVQLHVSKRSKEMALARLYYKTS-NH2 (SEQ ID NO: 2018) | | 0 |
| **JBT0669** | Ac-SGYASFPLAAQLHVSKRSKEMALARLYYKTS-NH2 (SEQ ID NO: 2133) | | 0 |
| **JBT0670** | Ac-SGYASFPLAVALHVSKRSKEMALARLYYKTS-NH2 (SEQ ID NO: 2007) | | 2 |
| **JBT0671** | Ac-SGYASFPLAVQAHVSKRSKEMALARLYYKTS-NH2 (SEQ ID NO: 2019) | | 7 |
| **JBT0672** | Ac-SGYASFPLAVQLAVSKRSKEMALARLYYKTS-NH2 (SEQ ID NO: 2134) | | 3 |
| **JBT0673** | Ac-SGYASFPLAVQLHASKRSKEMALARLYYKTS-NH2 (SEQ ID NO: 2135) | | 5 |
| **JBT0674** | Ac-SGYASFPLAVQLHVAKRSKEMALARLYYKTS-NH2 (SEQ ID NO: 2008) | | 5 |
| **JBT0675** | Ac-SGYASFPLAVQLHVSARSKEMALARLYYKTS-NH2 (SEQ ID NO: 2136) | | 7 |
| **JBT0676** | Ac-SGYASFPLAVQLHVSKASKEMALARLYYKTS-NH2 (SEQ ID NO: 2137) | | 1 |
| **JBT0677** | Ac-SGYASFPLAVQLHVSKRAKEMALARLYYKTS-NH2 (SEQ ID NO: 2009) | | 2 |
| **JBT0678** | Ac-SGYASFPLAVQLHVSKRSAEMALARLYYKTS-NH2 (SEQ ID NO: 2010) | | 2 |
| **JBT0679** | Ac-SGYASFPLAVQLHVSKRSKAMALARLYYKTS-NH2 (SEQ ID NO: 2020) | | 3 |

FIGURE 27C

| | | | |
|---|---|---|---|
| **JBT0680** | Ac-SGYASFPLAVQLHVSKRSKEAALARLYYKTS-NH2 (SEQ ID NO: 2138) | | 3 |
| **JBT0682** | Ac-SGYASFPLAVQLHVSKRSKEMAAARLYYKTS-NH2 (SEQ ID NO: 2139) | | 0 |
| **JBT0684** | Ac-SGYASFPLAVQLHVSKRSKEMALAALYYKTS-NH2 (SEQ ID NO: 2011) | | 2 |
| **JBT0685** | Ac-SGYASFPLAVQLHVSKRSKEMALARAYYKTS-NH2 (SEQ ID NO: 2021) | | 1 |
| **JBT0686** | Ac-SGYASFPLAVQLHVSKRSKEMALARLAYKTS-NH2 (SEQ ID NO: 2140) | | 1 |
| **JBT0687** | Ac-SGYASFPLAVQLHVSKRSKEMALARLYAKTS-NH2 (SEQ ID NO: 2141) | | 0 |
| **JBT0688** | Ac-SGYASFPLAVQLHVSKRSKEMALARLYYATS-NH2 (SEQ ID NO: 2012) | | 2 |
| **JBT0689** | Ac-SGYASFPLAVQLHVSKRSKEMALARLYYKAS-NH2 (SEQ ID NO: 2013) | | 2 |
| **JBT0690** | Ac-SGYASFPLAVQLHVSKRSKEMALARLYYKTA-NH2 (SEQ ID NO: 2014) | | 3 |
| **JBT1579** | Ac-GYASFPLAVQLHVAKRSKEMA-NH2 (SEQ ID NO: 2015) | | 5 |
| **JBT1580** | Ac-GYASFALSVQLHVSKRSKEMA-NH2 (SEQ ID NO: 2320) | | 6 |
| **JBT1581** | Ac-GYASFALAVQLHVAKRSKEMA-NH2 (SEQ ID NO: 2321) | | 13 |
| **JBT1582** | Ac-GYASFPLAVQLHVMKRSKEMA-NH2 (SEQ ID NO: 2022) | | 7 |
| **JBT1583** | Ac-GYASFALAVQLHVMKRSKEMA-NH2 (SEQ ID NO: 2322) | | 12 |
| **JBT1602** | Ac-LAVQLHVSKRSKEMALARL-NH2 (SEQ ID NO: 2326) | | 0 |

FIGURE 28D

| JBT0047 class | | Thrombin generation assay | | | | |
|---|---|---|---|---|---|---|
| **Peptide** | **Sequence** | **FEIBA-equivalent activity in FVIII-inhibited plasma @ 10µM peptide [mU/mL]** | **FEIBA-equivalent activity in FVIII-inhibited plasma @ 1.1µM peptide [mU/mL]** | **$EC_{50}$ (µM), FVIII-inhibited plasma** | **% FVIII-equivalent activity in FVIII deficient plasma @ 10µM peptide** | **% FVIII-equivalent activity in FVIII deficient plasma @ 1.1µM peptide** |
| **JBT0047** | Ac-SGVGRLQVAFQSKKNVFVFGYFERLRAKLTS-NH2 (SEQ ID NO: 253) | 156 | 87 | 0.89 | 24.6 | 20.0 |
| **JBT0131** | Biotin-Ttds-AFQSKKNVFVFGYFERLRAK-NH2 (SEQ ID NO: 964) | 106 | | | 4.5 | |
| **JBT0132** | Biotin-Ttds-FQSKKNVFVFGYFERLRAKL-NH2 (SEQ ID NO: 965) | 123 | | | 5.3 | |
| **JBT0133** | Biotin-Ttds-QSKKNVFVFGYFERLRAKLT-NH2 (SEQ ID NO: 966) | 28 | | | 6.7 | |
| **JBT0134** | Biotin-Ttds-QSKKNVFVFGYFERLRAK-NH2 (SEQ ID NO: 967) | 11 | | | | |
| **JBT0155** | Ac-KKSGVGRLQVAFQSKKNVFVFGYFERLRAKLTSKK-NH2 (SEQ ID NO: 8) | 49 | | | | |
| **JBT0158** | Ac-KKSGVGRLQVAFQSKKNVFVFGYFERLRAKKK-NH2 (SEQ ID NO: 9) | 30 | | | | |
| **JBT0162** | Ac-KKGRLQVAFQSKKNVFVFGYFERLRAKLTSKK-NH2 (SEQ ID NO: 10) | 54 | | | | |
| **JBT0163** | Ac-KKQVAFQSKKNVFVFGYFERLRAKLTSKK-NH2 (SEQ ID NO: 11) | 69 | | | | |
| **JBT0164** | Ac-KKFQSKKNVFVFGYFERLRAKLTSKK-NH2 (SEQ ID NO: 12) | 39 | | | | |
| **JBT0169** | Ac-KKAFQSKKNVFVFGYFERLRAKKK-NH2 (SEQ ID NO: 254) | 21 | | | | |

FIGURE 28E

| | | | | | | |
|---|---|---|---|---|---|---|
| **JBT0170** | Ac-KKFQSKKNVFVFGYFERLRAKLKK-NH2 (SEQ ID NO: 13) | 68 | | | | |
| **JBT0171** | Ac-KKQSKKNVFVFGYFERLRAKLTKK -NH2 (SEQ ID NO: 255) | 33 | | | | |
| **JBT0174** | Ac-KKAFQSKKNVFVFGYFERLRAKLKK-NH2 (SEQ ID NO: 14) | 49 | | | | |
| **JBT0175** | Ac-KKAFQSKKNVFVFGYFERLRAKLTKK-NH2 (SEQ ID NO: 182) | 49 | | | | |
| **JBT0293** | Ac-FQSKKNVFVFGYFERLRAKL-NH2 (SEQ ID NO: 256) | 106 | 34 | 1.60 | 7.1 | |
| **JBT0294** | Ac-YQSKKNVFVFGYFERLRAKL-NH2 (SEQ ID NO: 257) | 122 | | | 8.2 | |
| **JBT0296** | Ac-FQNKKNVFVFGYFERLRAKL-NH2 (SEQ ID NO: 407) | 79 | | | | |
| **JBT0297** | Ac-FQSKNNVFVFGYFERLRAKL-NH2 (SEQ ID NO: 183) | 147 | | | 11.3 | |
| **JBT0298** | Ac-FQSKQNVFVFGYFERLRAKL-NH2 (SEQ ID NO: 747) | 109 | | | | |
| **JBT0299** | Ac-FQSKKNVFAFGYFERLRAKL-NH2 (SEQ ID NO: 408) | 63 | | | | |
| **JBT0300** | Ac-FQSKKNVFSFGYFERLRAKL-NH2 (SEQ ID NO: 409) | 40 | | | | |
| **JBT0301** | Ac-FQSKKNVFTFGYFERLRAKL-NH2 (SEQ ID NO: 410) | 49 | | | | |
| **JBT0302** | Ac-FQSKKNVFVAGYFERLRAKL-NH2 (SEQ ID NO: 258) | 220 | | | 18.5 | |
| **JBT0303** | Ac-FQSKKNVFVDGYFERLRAKL-NH2 (SEQ ID NO: 184) | 220 | 126 | 0.85 | 21.8 | |
| **JBT0304** | Ac-FQSKKNVFVLGYFERLRAKL-NH2 (SEQ ID NO: 259) | 138 | | | | |
| **JBT0305** | Ac-FQSKKNVFVQGYFERLRAKL-NH2 (SEQ ID NO: 260) | 207 | 113 | | 20.5 | |
| **JBT0306** | Ac-FQSKKNVFVSGYFERLRAKL-NH2 (SEQ ID NO: 185) | 247 | 113 | | 17.4 | |
| **JBT0307** | Ac-FQSKKNVFVYGYFERLRAKL-NH2 (SEQ ID NO: 261) | 182 | 81 | | 16.8 | |
| **JBT0308** | Ac-FQSKKNVFVFGYKERLRAKL-NH2 (SEQ ID NO: 411) | 133 | | | | |
| **JBT0309** | Ac-FQSKKNVFVFGYYERLRAKL-NH2 (SEQ ID NO: 412) | 123 | | | | |
| **JBT0310** | Ac-FQSKKNVFVFGYFDRLRAKL-NH2 (SEQ ID NO: 262) | 163 | 50 | | | |
| **JBT0311** | Ac-FQSKKNVFVFGYFERLRAKN-NH2 (SEQ ID NO: 748) | 27 | | | | |
| **JBT0335** | Ac-FQSKKNVFVFGYFERLRAK-NH2 (SEQ ID NO: 749) | 28 | | | | |
| **JBT0336** | Ac-FQSKNNVFVAGYFDRLRAKL-OH (SEQ ID NO: 263) | 186 | 62 | | | |
| **JBT0337** | Ac-FQSKNNVFVDGYFDRLRAKL-NH2 (SEQ ID NO: 16) | 219 | 144 | | | |
| **JBT0338** | Ac-FQSKNNVFVQGYFDRLRAKL-NH2 (SEQ ID NO: 17) | 197 | 133 | | | |
| **JBT0339** | Ac-FQSKNNVFVSGYFDRLRAKL-NH2 (SEQ ID NO: 18) | 230 | 136 | | | |
| **JBT0340** | Ac-FQSKNNVFVYGYFDRLRAKL-NH2 (SEQ ID NO: 186) | 197 | 122 | | | |
| **JBT0341** | Ac-FQSKNNVFVFGYFDRLRAKL-NH2 (SEQ ID NO: 187) | 193 | 100 | | | |

FIGURE 28F

| | | | | | | |
|---|---|---|---|---|---|---|
| **JBT0342** | Ac-FQSKNNVFVDGYFERLRAKL-NH2 (SEQ ID NO: 19) | 244 | 178 | | 29.7 | 28.1 |
| **JBT0343** | Ac-FQSKKNVFVDGYFDRLRAKL-NH2 (SEQ ID NO: 188) | 239 | 126 | | | |
| **JBT0374** | Ac-FQSKDNVFVFGYFERLRAKL-NH2 (SEQ ID NO: 20) | 216 | 128 | | | |
| **JBT0375** | Ac-FQSKGNVFVFGYFERLRAKL-NH2 (SEQ ID NO: 190) | 180 | 140 | 0.47 | 22.9 | 22.9 |
| **JBT0376** | Ac-FQSKKNAFVFGYFERLRAKL-NH2 (SEQ ID NO: 414) | 101 | 22 | | | |
| **JBT0377** | Ac-FQSKKNQFVFGYFERLRAKL-NH2 (SEQ ID NO: 264) | 180 | 75 | | | |
| **JBT0378** | Ac-FQSKKNVFVEGYFERLRAKL-NH2 (SEQ ID NO: 21) | 245 | 148 | | 30.7 | 21.2 |
| **JBT0379** | Ac-FQSKKNVFVTGYFERLRAKL-NH2 (SEQ ID NO: 22) | 226 | 123 | | | |
| **JBT0380** | Ac-FQSKKNVFVVGYFERLRAKL-NH2 (SEQ ID NO: 191) | 199 | 102 | | | |
| **JBT0381** | Ac-FQSPKNVFVFGYFERLRAKL-NH2 (SEQ ID NO: 265) | 173 | 76 | | | |
| **JBT0386** | Ac-FQSKKNPFVFGYFERLRAKL-NH2 (SEQ ID NO: 415) | 85 | | | | |
| **JBT0388** | Ac-FQSKKNVHVFGYFERLRAKL-NH2 (SEQ ID NO: 192) | 185 | 82 | | | |
| **JBT0389** | Ac-FQSKKNVVVFGYFERLRAKL-NH2 (SEQ ID NO: 673) | 34 | | | | |
| **JBT0390** | Ac-FQSKKNVFQFGYFERLRAKL-NH2 (SEQ ID NO: 674) | 28 | | | | |
| **JBT0391** | Ac-FQSKKNVFVGGYFERLRAKL-NH2 (SEQ ID NO: 266) | 178 | 62 | | | |
| **JBT0392** | Ac-FQSKKNVFVHGYFERLRAKL-NH2 (SEQ ID NO: 23) | 228 | 112 | | | |
| **JBT0393** | Ac-FQSKKNVFVKGYFERLRAKL-NH2 (SEQ ID NO: 193) | 268 | 161 | | 38.8 | 30.1 |
| **JBT0394** | Ac-FQSKKNVFVMGYFERLRAKL-NH2 (SEQ ID NO: 24) | 115 | 43 | | | |
| **JBT0395** | Ac-FQSKKNVFVNGYFERLRAKL-NH2 (SEQ ID NO: 25) | 235 | 107 | | | |
| **JBT0396** | Ac-FQSKKNVFVPGYFERLRAKL-NH2 (SEQ ID NO: 194) | 196 | 85 | | | |
| **JBT0397** | Ac-FQSKKNVFVRGYFERLRAKL-NH2 (SEQ ID NO: 195) | 240 | 128 | | | |
| **JBT0402** | Biotin-Ttds-FQSKNNVFVFGYFERLRAKL-NH2 (SEQ ID NO: 973) | 185 | 159 | | | |
| **JBT0403** | Biotin-Ttds-FQSKKNVFVDGYFERLRAKL-NH2 (SEQ ID NO: 972) | 253 | 188 | | | |
| **JBT0404** | Biotin-Ttds-FQSKKNVFVFGYFDRLRAKL-NH2 (SEQ ID NO: 974) | 115 | 52 | | | |
| **JBT0405** | Biotin-FQSKKNVFVFGYFERLRAKL-NH2 (SEQ ID NO: 975) | 142 | 152 | | | |
| **JBT0406** | Ac-Ttds-FQSKKNVFVFGYFERLRAKL-NH2 (SEQ ID NO: 268) | 114 | 63 | | | |
| **JBT0471** | Ac-FQSKGNVFVTGYFERLRAKL-NH2 (SEQ ID NO: 26) | 193 | 164 | | 42.5 | 34.7 |
| **JBT0472** | Ac-FQSKGNVFVNGYFERLRAKL-NH2 (SEQ ID NO: 27) | 197 | 159 | | | |
| **JBT0473** | Ac-FQSKGNVFVHGYFERLRAKL-NH2 (SEQ ID NO: 28) | 188 | 145 | | | |

FIGURE 28G

| | | | | | | |
|---|---|---|---|---|---|---|
| **JBT0474** | Ac-FQSKGNVFVKGYFERLRAKL-NH2 (SEQ ID NO: 29) | 200 | 191 | | 50.5 | 45.2 |
| **JBT0475** | Ac-FQSKGNVFVEGYFERLRAKL-NH2 (SEQ ID NO: 30) | 202 | 165 | | | |
| **JBT0476** | Ac-FQSKGNVFVDGYFDRLRAKL-NH2 (SEQ ID NO: 31) | 202 | 164 | | 43.2 | 41.5 |
| **JBT0477** | Ac-FQSKGNVFVDGYFERLRAKL-NH2 (SEQ ID NO: 32) | 231 | 194 | 0.26 | 47.2 | 41.3 |
| **JBT0478** | Ac-FQSKDNVFVTGYFERLRAKL-NH2 (SEQ ID NO: 33) | 161 | 104 | | | |
| **JBT0479** | Ac-FQSKDNVFVNGYFERLRAKL-NH2 (SEQ ID NO: 34) | 161 | 105 | | | |
| **JBT0480** | Ac-FQSKDNVFVHGYFERLRAKL-NH2 (SEQ ID NO: 35) | 180 | 125 | | | |
| **JBT0481** | Ac-FQSKDNVFVKGYFERLRAKL-NH2 (SEQ ID NO: 36) | 168 | 124 | | | |
| **JBT0482** | Ac-FQSKDNVFVEGYFERLRAKL-NH2 (SEQ ID NO: 37) | 183 | 133 | | | |
| **JBT0483** | Ac-FQSKDNVFVDGYFERLRAKL-NH2 (SEQ ID NO: 38) | 191 | 136 | | | |
| **JBT0484** | Ac-FQSKDNVFVDGYFDRLRAKL-NH2 (SEQ ID NO: 976) | 178 | 111 | | | |
| **JBT0485** | Ac-FQSKNNVFVTGYFERLRAKL-NH2 (SEQ ID NO: 39) | 186 | 150 | | | |
| **JBT0486** | Ac-FQSKNNVFVNGYFERLRAKL-NH2 (SEQ ID NO: 40) | 171 | 112 | | | |
| **JBT0487** | Ac-FQSKNNVFVHGYFERLRAKL-NH2 (SEQ ID NO: 41) | 178 | 138 | | | |
| **JBT0488** | Ac-FQSKNNVFVKGYFERLRAKL-NH2 (SEQ ID NO: 42) | 193 | 153 | | | |
| **JBT0489** | Ac-FQSKNNVFVEGYFERLRAKL-NH2 (SEQ ID NO: 43) | 185 | 148 | | | |
| **JBT0490** | Ac-FQSKQNVFVTGYFERLRAKL-NH2 (SEQ ID NO: 44) | 162 | 79 | | | |
| **JBT0491** | Ac-FQSKQNVFVNGYFERLRAKL-NH2 (SEQ ID NO: 197) | 169 | 96 | | | |
| **JBT0492** | Ac-FQSKQNVFVHGYFERLRAKL-NH2 (SEQ ID NO: 198) | 124 | 69 | | | |
| **JBT0493** | Ac-FQSKQNVFVKGYFERLRAKL-NH2 (SEQ ID NO: 199) | 151 | 92 | | | |
| **JBT0494** | Ac-FQSKQNVFVDGYFERLRAKL-NH2 (SEQ ID NO: 45) | 163 | 102 | | | |
| **JBT0495** | Ac-FQSKQNVFVEGYFERLRAKL-NH2 (SEQ ID NO: 200) | 156 | 93 | | | |
| **JBT0497** | Ac-NmetPhe-QSKGNVFVFGYFERLRAKL-NH2 (SEQ ID NO: 201) | 165 | 106 | | | |
| **JBT0499** | Ac-FQS-NmetLys-GNVFVFGYFERLRAKL-NH2 (SEQ ID NO: 202) | 192 | 129 | | | |
| **JBT0500** | Ac-FQSK-NmetGly-NVFVFGYFERLRAKL-NH2 (SEQ ID NO: 46) | 254 | 239 | 0.17 | | 51.1 |
| **JBT0501** | Ac-FQSKGN-NmetV-FVFGYFERLRAKL-NH2 (SEQ ID NO: 417) | 95 | 21 | | | |
| **JBT0504** | Ac-FQSKGNVFV-NmetPhe-GYFERLRAKL-NH2 (SEQ ID NO: 418) | 62 | | | | |
| **JBT0505** | Ac-FQSKGNVFVF-NmetGly-YFERLRAKL-NH2 (SEQ ID NO: 269) | 204 | 90 | | | |
| **JBT0508** | Ac-FQSKGNVFVFGYF-NmetGlu-RLRAKL-NH2 (SEQ ID NO: 678) | 82 | | | | |

FIGURE 28H

| | | | | | | |
|---|---|---|---|---|---|---|
| **JBT0514** | Ac-FQSKGNVFVFGYFERLRAK-NmetLeu-NH2 (SEQ ID NO: 419) | 69 | | | | |
| **JBT0515** | Ac-bHomoPhe-QSKGNVFVFGYFERLRAKL-NH2 (SEQ ID NO: 420) | 86 | 31 | | | |
| **JBT0517** | Ac-FQ-bHomoSer-KGNVFVFGYFERLRAKL-NH2 (SEQ ID NO: 421) | 34 | | | | |
| **JBT0518** | Ac-FQS-bHomoLys-GNVFVFGYFERLRAKL-NH2 (SEQ ID NO: 422) | 38 | | | | |
| **JBT0519** | Ac-FQSK-bAla-NVFVFGYFERLRAKL-NH2 (SEQ ID NO: 270) | 105 | 37 | | | |
| **JBT0520** | Ac-FQSKG-bGln-VFVFGYFERLRAKL-NH2 (SEQ ID NO: 271) | 100 | 42 | | | |
| **JBT0522** | Ac-FQSKGNV-bHomoPhe-VFGYFERLRAKL-NH2 (SEQ ID NO: 681) | 40 | | | | |
| **JBT0524** | Ac-FQSKGNVFV-bHomoPhe-GYFERLRAKL-NH2 (SEQ ID NO: 682) | 36 | | | | |
| **JBT0527** | Ac-FQSKGNVFVFGY-bHomoPhe-ERLRAKL-NH2 (SEQ ID NO: 683) | 44 | | | | |
| **JBT0528** | Ac-FQSKGNVFVFGYF-bE-RLRAKL-NH2 (SEQ ID NO: 272) | 151 | 100 | | | |
| **JBT0531** | Ac-FQSKGNVFVFGYFERL-bHomoArg-AKL-NH2 (SEQ ID NO: 203) | 170 | 99 | | | |
| **JBT0532** | Ac-FQSKGNVFVFGYFERLR-bAla-KL-NH2 (SEQ ID NO: 423) | 118 | 53 | | | |
| **JBT0533** | Ac-FQSKGNVFVFGYFERLRA-bHomoK-L-NH2 (SEQ ID NO: 424) | 97 | 29 | | | |
| **JBT0534** | Ac-FQSKGNVFVFGYFERLRAK-Btl-NH2 (SEQ ID NO: 204) | 156 | 130 | | | |
| **JBT0535** | Ac-FQSKGNVFVFGYFE-Cit-LRAKL-NH2 (SEQ ID NO: 685) | 97 | 28 | | | |
| **JBT0536** | Ac-FQSKGNVFVFGYFERL-Cit-AKL-NH2 (SEQ ID NO: 273) | 196 | 133 | | | |
| **JBT0538** | Ac-FQSKGNVFVFGYFERL-Nle-AKL-NH2 (SEQ ID NO: 425) | 118 | 59 | | | |
| **JBT0564** | Ac-FQSKKNVFVFGYFKRLRAKL-NH2 (SEQ ID NO: 205) | 120 | 61 | | | |
| **JBT0613** | Ac-FQSKGNVFVFGYFERLRAKL-OH (SEQ ID NO: 283) | 156 | 55 | | | |
| **JBT0614** | NH2-FQSKGNVFVFGYFERLRAKL-OH (SEQ ID NO: 720) | 54 | | | | |
| **JBT0615** | NH2-FQSKGNVFVFGYFERLRAKL-NH2 (SEQ ID NO: 284) | 105 | 33 | | | |
| **JBT0616** | NH2-GSFQSKKNVFVDGYFERLRAKL-OH (SEQ ID NO: 285) | 162 | 77 | | | |
| **JBT0616** | NH2-GSFQSKKNVFVDGYFERLRAKL-OH (SEQ ID NO: 285) | 147 | 29 | | | |
| **JBT0651** | Ac-FQSKGNVHVKGYFERLRAKL-NH2 (SEQ ID NO: 48) | 250 | 216 | | | |
| **JBT0652** | Ac-FQSKGNVHVDGYFERLRAKL-NH2 (SEQ ID NO: 49) | | 207 | | | |
| **JBT0653** | Ac-FQSPGNVHVKGYFERLRAKL-NH2 (SEQ ID NO: 50) | | 237 | | | |
| **JBT0654** | Ac-FQSPGNVHVDGYFERLRAKL-NH2 (SEQ ID NO: 51) | | 214 | | | |
| **JBT0655** | Ac-FQSKGNIFVFGYFERLRAKL-NH2 (SEQ ID NO: 52) | 150 | 120 | | | |
| **JBT0656** | Ac-FQSKGNLFVFGYFERLRAKL-NH2 (SEQ ID NO: 286) | 86 | 42 | | | |

FIGURE 28I

| | | | | | | |
|---|---|---|---|---|---|---|
| **JBT0657** | Ac-FQSKGNVFIFGYFERLRAKL-NH2 (SEQ ID NO: 287) | 92 | 47 | | | |
| **JBT0663** | Ac-FQSKaNVFVFGYFERLRAKL-NH2 (SEQ ID NO: 53) | | 180 | | | |
| **JBT0668** | Ac-FQSKaNVFVTGYFARLRAKL-NH2 (SEQ ID NO: 54) | | 167 | | | |
| **JBT0681** | Ac-FQSK-Nmg-AVFVFGYFARLRAKL-NH2 (SEQ ID NO: 206) | | 158 | | | |
| **JBT0683** | Ac-FQSK-Nmg-AVFVDGYFARLRAKL-NH2 (SEQ ID NO: 55) | | 228 | | | |
| **JBT0696** | Ac-FQSKKAVFVFGYFERLRAKL-NH2 (SEQ ID NO: 288) | 64 | 60 | | | |
| **JBT0697** | Ac-FQSKGNVFVDGYFERL-Dap-AKL-NH2 (SEQ ID NO: 56) | | 188 | | | |
| **JBT0699** | Ac-FQSKGNVFVDGYFERL-Orn-AKL-NH2 (SEQ ID NO: 57) | | 207 | | | |
| **JBT0700** | Ac-FQSKGNVFVDGYFERL-Nva-AKL-NH2 (SEQ ID NO: 58) | | 218 | | | |
| **JBT0704** | Ac-FQSKKNVFVFGYFARLRAKL-NH2 (SEQ ID NO: 289) | 96 | 35 | | | |
| **JBT0708** | Ac-FQSKaNVFVAGYFERLRAKL-NH2 (SEQ ID NO: 59) | | 200 | | | |
| **JBT0714** | Ac-FQSKaAVFVDGYFARLRAKL-NH2 (SEQ ID NO: 60) | | 209 | | | |
| **JBT0717** | Ac-FQSK-Nmg-NVFVDGYFERLRAKL-NH2 (SEQ ID NO: 61) | 271 | 241 | 0.11 | | 42.1 |
| **JBT0720** | Ac-FQSK-Nmg-NVFVTGYFARLRAKL-NH2 (SEQ ID NO: 62) | | 271 | | | |
| **JBT0732** | Ac-FQSKGNVFVDGYFERL-Hci-AKL-NH2 (SEQ ID NO: 63) | | 258 | | | |
| **JBT0733** | Ac-FQSKGNVFVDGYFERL-Har-AKL-NH2 (SEQ ID NO: 64) | | 213 | | | |
| **JBT0739** | Ac-FQSKGNVFVDGYFERL-Opa-AKL-NH2 (SEQ ID NO: 65) | | 193 | | | |
| **JBT0740** | Ac-FQSKGNVFVDGYFERL-Aib-AKL-NH2 (SEQ ID NO: 66) | 236 | 184 | 0.29 | | 33.3 |
| **JBT0754** | Ac-FQSK-Nmg-AVFVTGYFARLRAKL-NH2 (SEQ ID NO: 67) | | 224 | | | |
| **JBT0759** | Ac-FQSKkNVFVFGYFERLRAKL-NH2 (SEQ ID NO: 207) | 159 | 131 | | | |
| **JBT0765** | Ac-FQSKGNVFVDGYFERL-Eew-AKL-NH2 (SEQ ID NO: 68) | | 205 | | | |
| **JBT0775** | Ac-FQSKGNVFVTGYFDRLRAKL-NH2 (SEQ ID NO: 69) | | 157 | | | |
| **JBT0778** | Ac-FQSKGNVFVKGYFDRLRAKL-NH2 (SEQ ID NO: 209) | | 176 | | | |
| **JBT0779** | Ac-FQSKGNVFVEGYFDRLRAKL-NH2 (SEQ ID NO: 210) | | 145 | | | |
| **JBT0780** | Ac-FQSK-Nmg-NVFVFGYFARLRAKL-NH2 (SEQ ID NO: 70) | | 227 | | | |
| **JBT0781** | Ac-FQSKGNVFVDGYFKRLRAKL-NH2 (SEQ ID NO: 211) | | 156 | | | |
| **JBT0789** | Ac-FQSK-Nmg-NVFVDGYFERL-Nle-AKL-NH2 (SEQ ID NO: 71) | 266 | 230 | 0.26 | | |
| **JBT0806** | Ac-FQSK-Nmg-NVFVAGYFARLRAKL-NH2 (SEQ ID NO: 74) | | 281 | | | |
| **JBT0837** | Ac-FQSK-Nmg-NVFVTGYFERL-Nle-AKL-NH2 (SEQ ID NO: 213) | | 259 | | | |

FIGURE 28J

| | | | | | | |
|---|---|---|---|---|---|---|
| **JBT0844** | Ac-FQSKaNVFVDGYFERLRAKL-NH2 (SEQ ID NO: 300) | | 195 | | | |
| **JBT0850** | Ac-FQSKaAVFVAGYFARLRAKL-NH2 (SEQ ID NO: 302) | | 174 | | | |
| **JBT0854** | Ac-FQSKaAVFVAGYFARL-Nle-AKL-NH2 (SEQ ID NO: 490) | | 34 | | | |
| **JBT0870** | Ac-FQSKaAVFVTGYFARLRAKL-NH2 (SEQ ID NO: 214) | | 167 | | | |
| **JBT0886** | Ac-FQSKaNVFVDGYFARLRAKL-NH2 (SEQ ID NO: 215) | | 186 | | | |
| **JBT0919** | Ac-FQSKaNVFVTGYFERLRAKL-NH2 (SEQ ID NO: 79) | | 204 | | | |
| **JBT0931** | Ac-FQSKGNVFVDGYFERL-Eag-AKL-NH2 (SEQ ID NO: 82) | | 172 | | | |
| **JBT0946** | Ac-FQSKGNVFVDGYFERL-Dab-AKL-NH2 (SEQ ID NO: 85) | | 177 | | | |
| **JBT0950** | Ac-FQSKaNVFVFGYFARLRAKL-NH2 (SEQ ID NO: 217) | | 115 | | | |
| **JBT0973** | Ac-FQSKGNVFVDGYFERL-Cha-AKL-NH2 (SEQ ID NO: 92) | | 193 | | | |
| **JBT1006** | Ac-FQSKGNVFVDGYFERL-Hle-AKL-NH2 (SEQ ID NO: 96) | | 210 | | | |
| **JBT1035** | Ac-FQSK-Nmg-AVFVAGYFARL-Nle-AKL-NH2 (SEQ ID NO: 218) | | 172 | | | |
| **JBT1037** | Ac-FQSKGNVFVDGYFERL-Nle-AKL-NH2 (SEQ ID NO: 104) | | 192 | | | |
| **JBT1043** | Ac-FQSKaNVFVDGYFERL-Nle-AKL-NH2 (SEQ ID NO: 106) | | 203 | | | |
| **JBT1082** | Ac-FQSKaAVFVFGYFARLRAKL-NH2 (SEQ ID NO: 565) | | 90 | | | |
| **JBT1084** | Ac-FQSK-Nmg-AVFVAGYFARLRAKL-NH2 (SEQ ID NO: 109) | | 192 | | | |
| **JBT1122** | Ac-FQSK-Nmg-NVFVDGYFARL-Nle-AKL-NH2 (SEQ ID NO: 113) | | 353 | | | |
| **JBT1133** | Ac-FQSKkAVFVDGYFARLRAKL-NH2 (SEQ ID NO: 115) | 233 | 236 | | | |
| **JBT1134** | Ac-FQSKGAVFVDGYFARLRAKL-NH2 (SEQ ID NO: 116) | 240 | 204 | | | |
| **JBT1135** | Ac-FQSKDAVFVDGYFARLRAKL-NH2 (SEQ ID NO: 221) | 227 | 146 | | | |
| **JBT1136** | Ac-FQSKdAVFVDGYFARLRAKL-NH2 (SEQ ID NO: 117) | 283 | 227 | | | |
| **JBT1137** | Ac-FQSKkAVFVAGYFARLRAKL-NH2 (SEQ ID NO: 118) | 218 | 231 | | | |
| **JBT1138** | Ac-FQSKGAVFVAGYFARLRAKL-NH2 (SEQ ID NO: 222) | 185 | 161 | | | |
| **JBT1139** | Ac-FQSKDAVFVAGYFARLRAKL-NH2 (SEQ ID NO: 223) | 205 | 146 | | | |
| **JBT1140** | Ac-FQSKdAVFVAGYFARLRAKL-NH2 (SEQ ID NO: 119) | 203 | 124 | | | |
| **JBT1141** | Ac-FQSKkAVFVKGYFARLRAKL-NH2 (SEQ ID NO: 120) | 223 | 217 | 0.12 | | |
| **JBT1142** | Ac-FQSKGAVFVKGYFARLRAKL-NH2 (SEQ ID NO: 224) | 299 | 233 | | | |
| **JBT1143** | Ac-FQSKDAVFVKGYFARLRAKL-NH2 (SEQ ID NO: 225) | 214 | 170 | | | |
| **JBT1144** | Ac-FQSKdAVFVKGYFARLRAKL-NH2 (SEQ ID NO: 121) | 200 | 164 | 0.21 | | |

FIGURE 28K

| | | | | | | |
|---|---|---|---|---|---|---|
| **JBT1145** | Ac-FQSKkAVFVTGYFARLRAKL-NH2 (SEQ ID NO: 122) | 274 | 243 | | | |
| **JBT1146** | Ac-FQSKGAVFVTGYFARLRAKL-NH2 (SEQ ID NO: 226) | 231 | 185 | | | |
| **JBT1147** | Ac-FQSKDAVFVTGYFARLRAKL-NH2 (SEQ ID NO: 227) | 230 | 146 | | | |
| **JBT1148** | Ac-FQSKdAVFVTGYFARLRAKL-NH2 (SEQ ID NO: 123) | 231 | 185 | | | |
| **JBT1151** | Ac-FQSKKNVFVFGYFERLRAKD-NH2 (SEQ ID NO: 937) | 27 | | | | |
| **JBT1153** | Ac-FQSKKNVFVFGYFERLGAKL-NH2 (SEQ ID NO: 705) | 125 | 45 | | | |
| **JBT1155** | Ac-FQSK-Nmg-NVFVTGYFERLRAKL-NH2 (SEQ ID NO: 125) | | 258 | | | |
| **JBT1156** | Ac-FQSKaNVFVDGYFARL-Nle-AKL-NH2 (SEQ ID NO: 126) | | 173 | | | |
| **JBT1157** | Ac-FQSKaNVFVAGYFARLRAKL-NH2 (SEQ ID NO: 127) | | 178 | | | |
| **JBT1584** | Ac-FQSK-Nmg-NVFVDGYFERL-Aib-AKL-NH2 (SEQ ID NO: 164) | 330 | 301 | 0.16 | | 48.6 |
| **JBT1585** | Ac-FQSK-Nmg-NVFVTGYFERL-Aib-AKL-NH2 (SEQ ID NO: 165) | 300 | 269 | 0.13 | | |
| **JBT1587** | Ac-FQSKGNVFVDGYFERL-Aib-AKLC-NH2 (SEQ ID NO: 167) | | 189 | 0.32 | | |
| **JBT1590** | Ac-FQSKGNVFV[CGYFERL-Aib-AKLC]-NH2 (SEQ ID NO: 401) | 35 | | | | |
| **JBT1591** | Ac-FQSKGNVFVDGYF[CRL-Aib-AKLC]-NH2 (SEQ ID NO: 168) | 148 | 75 | | | |
| **JBT1592** | Ac-[CFQSKGNVFVDGYFERLC]AKL-NH2 (SEQ ID NO: 402) | 138 | 46 | | | |
| **JBT1593** | Ac-FQSK[CNVFVDGYFERLC]AKL-NH2 (SEQ ID NO: 670) | 110 | 39 | | | |
| **JBT1594** | Ac-FQSKGNVFV[CGYFERLC]AKL-NH2 (SEQ ID NO: 671) | 35 | | | | |
| **JBT1595** | Ac-[CFQSKGNVFVC]GYFERL-Aib-AKL-NH2 (SEQ ID NO: 403) | 82 | 22 | | | |
| **JBT1596** | Ac-[CFQSKGC]VFVEGYFERL-Aib-AKL-NH2 (SEQ ID NO: 404) | 116 | 36 | | | |
| **JBT1853** | PEG(40kD)-FQSKGNVFVDGYFERL-Aib-AKL-NH2 (SEQ ID NO: 175) | | 605 | | | |
| **JBT1855** | Ac-FQSKGNVFVDGYFERL-Aib-AKLC(PEG40kD)-NH2 (SEQ ID NO: 252) | | 642 | | | |

FIGURE 29L

| JBT0120 class | | Thrombin generation assay | | | | |
|---|---|---|---|---|---|---|
| | | | | | | |
| **Peptide** | **Sequence** | **FEIBA-equivalent activity in FVIII-inhibited plasma @ 10µM peptide [mU/mL]** | **FEIBA-equivalent activity in FVIII-inhibited plasma @ 1.1µM peptide [mU/mL]** | **$EC_{50}$ (µM), FVIII-inhibited plasma** | **% FVIII-equivalent activity in FVIII deficient plasma @ 10µM peptide** | **% FVIII-equivalent activity in FVIII deficient plasma @ 1.1µM peptide** |
| **JBT0120** | Ac-SGASRYKWF[CGMRDMKGTMSC]VWVKFRYDTS-NH2 (SEQ ID NO: 1047) | 269 | 95 | 2.78 | 28.8 | 8.6 |
| **JBT0247** | Ac-SGASRYKWFCGMRDMKGTMSCVWVKFRYDTS-NH2 (SEQ ID NO: 1213) | 273 | | | | |
| **JBT0248** | Ac-KKSGASRYKWF[CGMRDMKGTMSC]VWVKFRYDTSKK-NH2 (SEQ ID NO: 1001) | 164 | | | | |
| **JBT0319** | Ac-SGASRYKWF[CGMRDMKGTMSC]VWVKFRY-NH2 (SEQ ID NO: 1075) | 383 | 187 | | 29.3 | |
| **JBT0320** | Ac-SGASRYKWF[CGMRDMKGTMSC]VWVK-NH2 (SEQ ID NO: 1103) | 153 | 21 | | | |
| **JBT0323** | Ac-SRYKWF[CGMRDMKGTMSC]VWVKFRYDTS-NH2 (SEQ ID NO: 1076) | 355 | 142 | | 31.4 | |
| **JBT0324** | Ac-KWF[CGMRDMKGTMSC]VWVKFRYDTS-NH2 (SEQ ID NO: 1155) | 91 | | | | |
| **JBT0329** | Ac-KWF[CGMRDMKGTMSC]VWVKF-NH2 (SEQ ID NO: 1156) | 70 | | | 6.6 | |
| **JBT0333** | Ac-KWFCGMRDMKGTMSCVWVKF-NH2 (SEQ ID NO: 1207) | 40 | | | | |
| **JBT0333** | Ac-KWFCGMRDMKGTMSCVWVKF-NH2 (SEQ ID NO: 1207) | 114 | | | | |
| **JBT0411** | Ac-SGASRYKWF[CG-Nle-RD-Nle-KGT-Nle-SC]VWVKFRYDTS-NH2 (SEQ ID NO: 1104) | 97 | | | | |

FIGURE 29M

| | | | | | | |
|---|---|---|---|---|---|---|
| **JBT0412** | Ac-KWF[CG-Nle-RD-Nle-KGT-Nle-SC]VWVKF-NH2 (SEQ ID NO: 1209) | 46 | | | | |
| **JBT0415** | Ac-SRYKWF[CGMRDMKGTMSC]VWVKF-NH2 (SEQ ID NO: 1003) | 291 | 182 | 0.57 | 47.2 | 36.5 |
| **JBT0416** | Ac-SRYKWF[CG-Nle-RD-Nle-KGT-Nle-SC]VWVKF-NH2 (SEQ ID NO: 1077) | 256 | 95 | | 36.6 | 22.3 |
| **JBT0437** | Ac-ARYKWF[CGMRDMKGTMSC]VWVKF-NH2 (SEQ ID NO: 1048) | 362 | 225 | | | |
| **JBT0438** | Ac-SAYKWF[CGMRDMKGTMSC]VWVKF-NH2 (SEQ ID NO: 1078) | 300 | 137 | | | |
| **JBT0439** | Ac-SRAKWF[CGMRDMKGTMSC]VWVKF-NH2 (SEQ ID NO: 1105) | 266 | 88 | | | |
| **JBT0440** | Ac-SRYAWF[CGMRDMKGTMSC]VWVKF-NH2 (SEQ ID NO: 1106) | 175 | 33 | | | |
| **JBT0441** | Ac-SRYKAF[CGMRDMKGTMSC]VWVKF-NH2 (SEQ ID NO: 1230) | 18 | 5 | | | |
| **JBT0442** | Ac-SRYKWA[CGMRDMKGTMSC]VWVKF-NH2 (SEQ ID NO: 1231) | 53 | 8 | | | |
| **JBT0444** | Ac-SRYKWF[CAMRDMKGTMSC]VWVKF-NH2 (SEQ ID NO: 1004) | 331 | 229 | 0.42 | 53.4 | 45.7 |
| **JBT0445** | Ac-SRYKWF[CGARDMKGTMSC]VWVKF-NH2 (SEQ ID NO: 1107) | 157 | 40 | | | |
| **JBT0446** | Ac-SRYKWF[CGMADMKGTMSC]VWVKF-NH2 (SEQ ID NO: 1079) | 287 | 140 | | | |
| **JBT0447** | Ac-SRYKWF[CGMRAMKGTMSC]VWVKF-NH2 (SEQ ID NO: 1158) | 101 | | | | |
| **JBT0448** | Ac-SRYKWF[CGMRDAKGTMSC]VWVKF-NH2 (SEQ ID NO: 1108) | 324 | 138 | | | |
| **JBT0449** | Ac-SRYKWF[CGMRDMAGTMSC]VWVKF-NH2 (SEQ ID NO: 1080) | 362 | 217 | | 54.1 | 34.2 |
| **JBT0450** | Ac-SRYKWF[CGMRDMKATMSC]VWVKF-NH2 (SEQ ID NO: 1159) | 232 | 68 | | | |
| **JBT0451** | Ac-SRYKWF[CGMRDMKGAMSC]VWVKF-NH2 (SEQ ID NO: 1081) | 339 | 189 | | | |
| **JBT0452** | Ac-SRYKWF[CGMRDMKGTASC]VWVKF-NH2 (SEQ ID NO: 1109) | 265 | 119 | | | |
| **JBT0453** | Ac-SRYKWF[CGMRDMKGTMAC]VWVKF-NH2 (SEQ ID NO: 1110) | 282 | 111 | | | |
| **JBT0455** | Ac-SRYKWF[CGMRDMKGTMSC]AWVKF-NH2 (SEQ ID NO: 1049) | 316 | 203 | | | |
| **JBT0456** | Ac-SRYKWFCGMRDMKGTMSCVAVKF-NH2 (SEQ ID NO: 1232) | 16 | | | | |
| **JBT0457** | Ac-SRYKWF[CGMRDMKGTMSC]VWAKF-NH2 (SEQ ID NO: 1161) | 76 | | | | |
| **JBT0458** | Ac-SRYKWF[CGMRDMKGTMSC]VWVAF-NH2 (SEQ ID NO: 1082) | 292 | 161 | | | |
| **JBT0459** | Ac-SRYKWF[CGMRDMKGTMSC]VWVKA-NH2 (SEQ ID NO: 1083) | 266 | 137 | | | |
| **JBT0460** | Ac-RYKWF[CGMRDMKGTMSC]VWVKF-NH2 (SEQ ID NO: 1050) | 262 | 138 | | | |
| **JBT0461** | Ac-YKWF[CGMRDMKGTMSC]VWVKF-NH2 (SEQ ID NO: 1111) | 197 | 47 | | | |
| **JBT0625** | Ac-SRYKWF[CMRDMKGTMSC]VWVKF-NH2 (SEQ ID NO: 1244) | 5 | 3 | | | |
| **JBT0626** | Ac-SRYKWF[CGMRDKGTMSC]VWVKF-NH2 (SEQ ID NO: 1164) | 81 | 10 | | | |

FIGURE 29N

| | | | | | | |
|---|---|---|---|---|---|---|
| **JBT0627** | Ac-SRYKWF[CGMRDMGTMSC]VWVKF-NH2 (SEQ ID NO: 1165) | 62 | 15 | | | |
| **JBT0628** | Ac-SRYKWF[CGMRDMKGMSC]VWVKF-NH2 (SEQ ID NO: 1166) | 54 | 16 | | | |
| **JBT0631** | Ac-SRYKWF[CGmRDMKGTMSC]VWVKF-NH2 (SEQ ID NO: 1113) | 171 | 60 | | | |
| **JBT0634** | Ac-SRYKWF[CGMRDmKGTMSC]VWVKF-NH2 (SEQ ID NO: 1051) | 311 | 156 | | | |
| **JBT0635** | Ac-SRYKWF[CGMRDMkGTMSC]VWVKF-NH2 (SEQ ID NO: 1114) | 123 | | | | |
| **JBT0641** | Ac-SRYKWF[CPMRDMKGTMSC]VWVKF-NH2 (SEQ ID NO: 1247) | 21 | | | | |
| **JBT0642** | Ac-SRYKWF[CGPRDMKGTMSC]VWVKF-NH2 (SEQ ID NO: 1248) | 32 | | | | |
| **JBT0643** | Ac-SRYKWF[CGMPDMKGTMSC]VWVKF-NH2 (SEQ ID NO: 1006) | 289 | 192 | 0.63 | | |
| **JBT0644** | Ac-SRYKWF[CGMRPMKGTMSC]VWVKF-NH2 (SEQ ID NO: 1172) | 31 | | | | |
| **JBT0645** | Ac-SRYKWF[CGMRDPKGTMSC]VWVKF-NH2 (SEQ ID NO: 1084) | | 109 | | | |
| **JBT0646** | Ac-SRYKWF[CGMRDMPGTMSC]VWVKF-NH2 (SEQ ID NO: 1173) | 84 | | | | |
| **JBT0648** | Ac-SRYKWF[CGMRDMKGPMSC]VWVKF-NH2 (SEQ ID NO: 1174) | 42 | | | | |
| **JBT0649** | Ac-SRYKWF[CGMRDMKGTPSC]VWVKF-NH2 (SEQ ID NO: 1175) | 64 | | | | |
| **JBT1416** | Ac-DRYKWF[CGMRDMKGTMSC]VWVKF-NH2 (SEQ ID NO: 1007) | 253 | 102 | 1.38 | | |
| **JBT1417** | Ac-SDYKWF[CGMRDMKGTMSC]VWVKF-NH2 (SEQ ID NO: 1116) | 140 | 30 | 4.79 | | |
| **JBT1418** | Ac-SRDKWF[CGMRDMKGTMSC]VWVKF-NH2 (SEQ ID NO: 1176) | 67 | | 3.15 | | |
| **JBT1419** | Ac-SRYDWF[CGMRDMKGTMSC]VWVKF-NH2 (SEQ ID NO: 1117) | 120 | | 3.80 | | |
| **JBT1426** | Ac-SRYKWF[CGMRDMDGTMSC]VWVKF-NH2 (SEQ ID NO: 1008) | 287 | 135 | 0.94 | | |
| **JBT1436** | Ac-FRYKWF[CGMRDMKGTMSC]VWVKF-NH2 (SEQ ID NO: 1053) | 228 | 72 | 2.54 | | |
| **JBT1437** | Ac-SFYKWF[CGMRDMKGTMSC]VWVKF-NH2 (SEQ ID NO: 1010) | 284 | 157 | 0.85 | | |
| **JBT1438** | Ac-SRFKWF[CGMRDMKGTMSC]VWVKF-NH2 (SEQ ID NO: 1011) | 218 | 81 | 1.63 | | |
| **JBT1445** | Ac-SRYKWF[CGMRDFKGTMSC]VWVKF-NH2 (SEQ ID NO: 1012) | 213 | 89 | 1.75 | | |
| **JBT1446** | Ac-SRYKWF[CGMRDMFGTMSC]VWVKF-NH2 (SEQ ID NO: 1054) | 169 | 64 | 1.53 | | |
| **JBT1448** | Ac-SRYKWF[CGMRDMKGFMSC]VWVKF-NH2 (SEQ ID NO: 1123) | 184 | 34 | | | |
| **JBT1449** | Ac-SRYKWF[CGMRDMKGTFSC]VWVKF-NH2 (SEQ ID NO: 1013) | 276 | 116 | 1.45 | | |
| **JBT1455** | Ac-GRYKWF[CGMRDMKGTMSC]VWVKF-NH2 (SEQ ID NO: 1014) | 226 | 66 | 2.50 | | |
| **JBT1465** | Ac-SRYKWF[CGMRDMGGTMSC]VWVKF-NH2 (SEQ ID NO: 1015) | 235 | 74 | 2.46 | | |
| **JBT1474** | Ac-KRYKWF[CGMRDMKGTMSC]VWVKF-NH2 (SEQ ID NO: 1016) | 275 | 136 | 1.06 | | |
| **JBT1481** | Ac-SRYKWF[CGMKDMKGTMSC]VWVKF-NH2 (SEQ ID NO: 1017) | 303 | 123 | 1.48 | | |

FIGURE 29O

| | | | | | | |
|---|---|---|---|---|---|---|
| **JBT1483** | Ac-SRYKWF[CGMRDKKGTMSC]VWVKF-NH2 (SEQ ID NO: 1057) | 275 | 88 | | | |
| **JBT1492** | Ac-LRYKWF[CGMRDMKGTMSC]VWVKF-NH2 (SEQ ID NO: 1018) | 239 | 100 | 1.55 | | |
| **JBT1493** | Ac-SLYKWF[CGMRDMKGTMSC]VWVKF-NH2 (SEQ ID NO: 1060) | 261 | 122 | 1.17 | | |
| **JBT1502** | Ac-SRYKWF[CGMRDLKGTMSC]VWVKF-NH2 (SEQ ID NO: 1019) | 307 | 175 | 0.77 | | |
| **JBT1503** | Ac-SRYKWF[CGMRDMLGTMSC]VWVKF-NH2 (SEQ ID NO: 1063) | 202 | 105 | 0.95 | | |
| **JBT1506** | Ac-SRYKWF[CGMRDMKGTLSC]VWVKF-NH2 (SEQ ID NO: 1064) | 191 | 49 | 2.99 | | |
| **JBT1512** | Ac-SRYKWF[CGMRDMKGTMSC]VWVKL-NH2 (SEQ ID NO: 1020) | 294 | 152 | 0.89 | | |
| **JBT1523** | Ac-SRYKWF[CGMRDMSGTMSC]VWVKF-NH2 (SEQ ID NO: 1022) | 255 | 115 | 1.30 | | |
| **JBT1541** | Ac-SRYKWF[CGMRDMKGTMSC]VWVPF-NH2 (SEQ ID NO: 1023) | 291 | 155 | 0.82 | | |
| **JBT1543** | Ac-SRYKWF[CGMRDMKGTMSC]VWVKF-OH (SEQ ID NO: 1098) | 192 | 39 | 3.10 | | |
| **JBT1544** | H-SRYKWF[CGMRDMKGTMSC]VWVKF-NH2 (SEQ ID NO: 1024) | 235 | 98 | | | |
| **JBT1545** | H-SRYKWF[CGMRDMKGTMSC]VWVKF-OH (SEQ ID NO: 1099) | 152 | 21 | 7.92 | | |
| **JBT1557** | H-RYKWF[CGMRDMKGTMSC]VWVKF-NH2 (SEQ ID NO: 173) | 208 | 91 | | | |
| **JBT1558** | H-YKWF[CGMRDMKGTMSC]VWVKF-NH2 (SEQ ID NO: 1149) | 115 | 20 | | | |
| **JBT1559** | Ac-SRYKWF[CGaRDMKGTMSC]VWVKF-NH2 (SEQ ID NO: 1150) | 131 | 42 | | | |
| **JBT1562** | Ac-SRYKWF[CGkRDMKGTMSC]VWVKF-NH2 (SEQ ID NO: 1193) | 54 | | | | |
| **JBT1567** | Ac-SRYKWF[CGMRDdKGTMSC]VWVKF-NH2 (SEQ ID NO: 1101) | 226 | 76 | | | |
| **JBT1570** | Ac-SRYKWF[CGMRDlKGTMSC]VWVKF-NH2 (SEQ ID NO: 1025) | 250 | 76 | | | |
| **JBT1574** | Ac-SRYKWF[CGMRDMdGTMSC]VWVKF-NH2 (SEQ ID NO: 1153) | 173 | 34 | | | |

FIGURE 30A

| JBT0122 class | | Thrombin generation assay | | | | |
|---|---|---|---|---|---|---|
| | | | | | | |
| **Peptide** | **Sequence** | **FEIBA-equivalent activity in FVIII-inhibited plasma @ 10µM peptide [mU/mL]** | **FEIBA-equivalent activity in FVIII-inhibited plasma @ 1.1µM peptide [mU/mL]** | **$EC_{50}$ (µM), FVIII-inhibited plasma** | **% FVIII-equivalent activity in FVIII deficient plasma @ 10µM peptide** | **% FVIII-equivalent activity in FVIII deficient plasma @ 1.1µM peptide** |
| **JBT0122** | AC-SGYASFPLAVQLHVSKRSKEMALARLYYKTS-NH2 (SEQ ID NO: 2002) | 170 | 31 | | 160 | |
| **JBT0221** | Ac-KKSGYASFPLAVQLHVSKRSKEMALARLYYKTSKK-NH2 (SEQ ID NO: 2003) | 206 | 150 | | | |
| **JBT0224** | Ac-KKSGYASFPLAVQLHVSKRSKEMALARLYYKK-NH2 (SEQ ID NO: 2298) | 152 | 58 | 1.10 | 162 | |
| **JBT0225** | Ac-KKSGYASFPLAVQLHVSKRSKEMALARKK-NH2 (SEQ ID NO: 2128) | 55 | | | | |
| **JBT0367** | Ac-ASFPLAVQLHVSKRSKEMALARL-NH2 (SEQ ID NO: 2317) | 28 | | | | |
| **JBT0368** | Ac-ASFPLAVQLHVSKRSKEMALARLY-NH2 (SEQ ID NO: 2130) | 36 | | | | |
| **JBT0369** | Ac-ASFPLAVQLHVSKRSKEMALARLYY-NH2 (SEQ ID NO: 2017) | 68 | | | | |
| **JBT0370** | Ac-YASFPLAVQLHVSKRSKEMA-NH2 (SEQ ID NO: 2318) | 39 | | | | |
| **JBT0371** | Ac-GYASFPLAVQLHVSKRSKEMA-NH2(SEQ ID NO: 2319) | 25 | | | | |
| **JBT0660** | Ac-AGYASFPLAVQLHVSKRSKEMALARLYYKTS-NH2 (SEQ ID NO: 2004) | 141 | 27 | | | |
| **JBT0661** | Ac-SAYASFPLAVQLHVSKRSKEMALARLYYKTS-NH2 (SEQ ID NO: | 215 | 49 | | | |

FIGURE 30B

| | | | | | | |
|---|---|---|---|---|---|---|
| | 2005) | | | | | |
| **JBT0662** | Ac-SGAASFPLAVQLHVSKRSKEMALARLYYKTS-NH2 (SEQ ID NO: 2131) | 43 | | | | |
| **JBT0664** | Ac-SGYAAFPLAVQLHVSKRSKEMALARLYYKTS-NH2 (SEQ ID NO: 2006) | 178 | 26 | | | |
| **JBT0665** | Ac-SGYASAPLAVQLHVSKRSKEMALARLYYKTS-NH2 (SEQ ID NO: 2132) | 49 | | | | |
| **JBT0666** | Ac-SGYASFALAVQLHVSKRSKEMALARLYYKTS-NH2 (SEQ ID NO: 2001) | 99 | 23 | | | |
| **JBT0667** | Ac-SGYASFPAAVQLHVSKRSKEMALARLYYKTS-NH2 (SEQ ID NO: 2018) | 95 | | | | |
| **JBT0669** | Ac-SGYASFPLAAQLHVSKRSKEMALARLYYKTS-NH2 (SEQ ID NO: 2133) | 20 | | | | |
| **JBT0670** | Ac-SGYASFPLAVALHVSKRSKEMALARLYYKTS-NH2 (SEQ ID NO: 2007) | 101 | | | | |
| **JBT0671** | Ac-SGYASFPLAVQAHVSKRSKEMALARLYYKTS-NH2 (SEQ ID NO: 2019) | 120 | | | | |
| **JBT0673** | Ac-SGYASFPLAVQLHASKRSKEMALARLYYKTS-NH2 (SEQ ID NO: 2135) | 39 | | | | |
| **JBT0674** | Ac-SGYASFPLAVQLHVAKRSKEMALARLYYKTS-NH2 (SEQ ID NO: 2008) | 234 | 90 | | | |
| **JBT0675** | Ac-SGYASFPLAVQLHVSARSKEMALARLYYKTS-NH2 (SEQ ID NO: 2136) | 20 | | | | |
| **JBT0677** | Ac-SGYASFPLAVQLHVSKRAKEMALARLYYKTS-NH2 (SEQ ID NO: 2009) | 178 | 37 | | | |
| **JBT0678** | Ac-SGYASFPLAVQLHVSKRSAEMALARLYYKTS-NH2 (SEQ ID NO: 2010) | 153 | 23 | | | |
| **JBT0679** | Ac-SGYASFPLAVQLHVSKRSKAMALARLYYKTS-NH2 (SEQ ID NO: 2020) | 20 | | | | |
| **JBT0682** | Ac-SGYASFPLAVQLHVSKRSKEMAAARLYYKTS-NH2 (SEQ ID NO: | 133 | 27 | | | |

FIGURE 30C

| | | | | | | |
|---|---|---|---|---|---|---|
| | 2139) | | | | | |
| **JBT0684** | Ac-SGYASFPLAVQLHVSKRSKEMALAALYYKTS-NH2 (SEQ ID NO: 2011) | 159 | 28 | | | |
| **JBT0685** | Ac-SGYASFPLAVQLHVSKRSKEMALARAYYKTS-NH2 (SEQ ID NO: 2021) | 131 | 21 | | | |
| **JBT0686** | Ac-SGYASFPLAVQLHVSKRSKEMALARLAYKTS-NH2 (SEQ ID NO: 2140) | 109 | | | | |
| **JBT0687** | Ac-SGYASFPLAVQLHVSKRSKEMALARLYAKTS-NH2 (SEQ ID NO: 2141) | 124 | | | | |
| **JBT0688** | Ac-SGYASFPLAVQLHVSKRSKEMALARLYYATS-NH2 (SEQ ID NO: 2012) | 148 | 29 | | | |
| **JBT0689** | Ac-SGYASFPLAVQLHVSKRSKEMALARLYYKAS-NH2 (SEQ ID NO: 2013) | 184 | 40 | | | |
| **JBT0690** | Ac-SGYASFPLAVQLHVSKRSKEMALARLYYKTA-NH2 (SEQ ID NO: 2014) | 187 | 41 | | | |
| **JBT1579** | Ac-GYASFPLAVQLHVAKRSKEMA-NH2 (SEQ ID NO: 2015) | 66 | | | | |
| **JBT1581** | Ac-GYASFALAVQLHVAKRSKEMA-NH2 (SEQ ID NO: 2321) | 67 | | | | |
| **JBT1582** | Ac-GYASFPLAVQLHVMKRSKEMA-NH2 (SEQ ID NO: 2022) | 73 | | | | |
| **JBT1583** | Ac-GYASFALAVQLHVMKRSKEMA-NH2 (SEQ ID NO: 2322) | 68 | | | | |

FIGURE 32A

| Object ID | % Inhibition (relative to JBT-0477) | IC50 Mean (nM] | Affinity Class | Sequence | SEQ ID NO: |
|---|---|---|---|---|---|
| JBT0047 | | 115 | C | Ac-SGVGRLQVAFQSKKNVFVFGYFERLRAKLTS-NH2 | 253 |
| JBT0155 | | 30 | A | Ac-KKSGVGRLQVAFQSKKNVFVFGYFERLRAKLTSKK-NH2 | 8 |
| JBT0156* | | >4170 | | Ac-VVEKLTFVQLSFLNRRRFSQYAGFKGAGKV-NH2 | 742 |
| JBT0157* | | >4170 | | Ac-RVFLYFSGKAGGLVKLVERQAFQTNVSKFR-NH2 | 743 |
| JBT0158 | | 41 | A | Ac-KKSGVGRLQVAFQSKKNVFVFGYFERLRAKKK-NH2 | 9 |
| JBT0159 | | >8300 | | Ac-KKSGVGRLQVAFQSKKNVFVFGYFERLKK-NH2 | 744 |
| JBT0160 | | >8300 | | Ac-KKSGVGRLQVAFQSKKNVFVFGYFKK-NH2 | 745 |
| JBT0161 | | >8300 | | Ac-KKSGVGRLQVAFQSKKNVFVFKK-NH2 | 746 |
| JBT0162 | | 36 | A | Ac-KKGRLQVAFQSKKNVFVFGYFERLRAKLTSKK-NH2 | 10 |
| JBT0163 | | 18 | A | Ac-KKQVAFQSKKNVFVFGYFERLRAKLTSKK-NH2 | 11 |
| JBT0164 | | 43 | A | Ac-KKFQSKKNVFVFGYFERLRAKLTSKK-NH2 | 12 |
| JBT0165 | | 6134 | F | Ac-KKKKNVFVFGYFERLRAKLTSKK-NH2 | 712 |
| JBT0169 | | 120 | C | Ac-KKAFQSKKNVFVFGYFERLRAKKK-NH2 | 254 |
| JBT0170 | | 39 | A | Ac-KKFQSKKNVFVFGYFERLRAKLKK-NH2 | 13 |
| JBT0171 | | 123 | C | Ac-KKQSKKNVFVFGYFERLRAKLTKK -NH2 | 255 |
| JBT0172 | | 295 | D | Ac-KKQSKKNVFVFGYFERLRAKKK-NH2 | 406 |
| JBT0174 | | 44 | A | Ac-KKAFQSKKNVFVFGYFERLRAKLKK-NH2 | 14 |
| JBT0175 | | 65 | B | Ac-KKAFQSKKNVFVFGYFERLRAKLTKK-NH2 | 182 |
| JBT0291 | | 46 | A | Ac-K(FAM)KSGVGRLQVAFQSKKNVFVFGYFERLRAKLTSKK-NH2 | 15 |
| JBT0293 | 61 | 179 | C | Ac-FQSKKNVFVFGYFERLRAKL-NH2 | 256 |
| JBT0294 | | 188 | C | Ac-YQSKKNVFVFGYFERLRAKL-NH2 | 257 |
| JBT0295 | 37 | 2777 | F | Ac-FSSKKNVFVFGYFERLRAKL-NH2 | 713 |
| JBT0296 | | 575 | D | Ac-FQNKKNVFVFGYFERLRAKL-NH2 | 407 |
| JBT0297 | | 63 | B | Ac-FQSKNNVFVFGYFERLRAKL-NH2 | 183 |

FIGURE 32B

| Object ID | % Inhibition (relative to JBT-0477) | IC50 Mean (nM] | Affinity Class | Sequence | SEQ ID NO: |
|---|---|---|---|---|---|
| JBT0298 | | >206 | | Ac-FQSKQNVFVFGYFERLRAKL-NH2 | 747 |
| JBT0299 | 25 | 446 | D | Ac-FQSKKNVFAFGYFERLRAKL-NH2 | 408 |
| JBT0300 | | 943 | D | Ac-FQSKKNVFSFGYFERLRAKL-NH2 | 409 |
| JBT0301 | | 671 | D | Ac-FQSKKNVFTFGYFERLRAKL-NH2 | 410 |
| JBT0302 | 55 | 133 | C | Ac-FQSKKNVFVAGYFERLRAKL-NH2 | 258 |
| JBT0303 | 66 | 85 | B | Ac-FQSKKNVFVDGYFERLRAKL-NH2 | 184 |
| JBT0304 | 54 | 231 | C | Ac-FQSKKNVFVLGYFERLRAKL-NH2 | 259 |
| JBT0305 | | 154 | C | Ac-FQSKKNVFVQGYFERLRAKL-NH2 | 260 |
| JBT0306 | 50 | 89 | B | Ac-FQSKKNVFVSGYFERLRAKL-NH2 | 185 |
| JBT0307 | | 108 | C | Ac-FQSKKNVFVYGYFERLRAKL-NH2 | 261 |
| JBT0308 | | 736 | D | Ac-FQSKKNVFVFGYKERLRAKL-NH2 | 411 |
| JBT0309 | | 565 | D | Ac-FQSKKNVFVFGYYERLRAKL-NH2 | 412 |
| JBT0310 | 66 | 146 | C | Ac-FQSKKNVFVFGYFDRLRAKL-NH2 | 262 |
| JBT0311 | | >50000 | | Ac-FQSKKNVFVFGYFERLRAKN-NH2 | 748 |
| JBT0335 | | >50000 | | Ac-FQSKKNVFVFGYFERLRAK-NH2 | 749 |
| JBT0336 | | 232 | C | Ac-FQSKNNVFVAGYFDRLRAKL-OH | 263 |
| JBT0337 | | 32 | A | Ac-FQSKNNVFVDGYFDRLRAKL-NH2 | 16 |
| JBT0338 | | 32 | A | Ac-FQSKNNVFVQGYFDRLRAKL-NH2 | 17 |
| JBT0339 | | 46 | A | Ac-FQSKNNVFVSGYFDRLRAKL-NH2 | 18 |
| JBT0340 | | 68 | B | Ac-FQSKNNVFVYGYFDRLRAKL-NH2 | 186 |
| JBT0341 | | 75 | B | Ac-FQSKNNVFVFGYFDRLRAKL-NH2 | 187 |
| JBT0342 | 90 | 47 | A | Ac-FQSKNNVFVDGYFERLRAKL-NH2 | 19 |
| JBT0343 | | 83 | B | Ac-FQSKKNVFVDGYFDRLRAKL-NH2 | 188 |
| JBT0372 | | 313 | D | Fam-Ttds-AFQSKKNVFVFGYFERLRAK-NH2 | 413 |
| JBT0373 | | 97 | B | Fam-AFQSKKNVFVFGYFERLRAK-NH2 | 189 |

FIGURE 32C

| Object ID | % Inhibition (relative to JBT-0477) | IC50 Mean (nM] | Affinity Class | Sequence | SEQ ID NO: |
|---|---|---|---|---|---|
| JBT0374 | | 25 | A | Ac-FQSKDNVFVFGYFERLRAKL-NH2 | 20 |
| JBT0375 | 101 | 56 | B | Ac-FQSKGNVFVFGYFERLRAKL-NH2 | 190 |
| JBT0376 | 32 | 254 | D | Ac-FQSKKNAFVFGYFERLRAKL-NH2 | 414 |
| JBT0377 | | 146 | C | Ac-FQSKKNQFVFGYFERLRAKL-NH2 | 264 |
| JBT0378 | | 39 | A | Ac-FQSKKNVFVEGYFERLRAKL-NH2 | 21 |
| JBT0379 | | 27 | A | Ac-FQSKKNVFVTGYFERLRAKL-NH2 | 22 |
| JBT0380 | | 81 | B | Ac-FQSKKNVFVVGYFERLRAKL-NH2 | 191 |
| JBT0381 | 40 | 154 | C | Ac-FQSPKNVFVFGYFERLRAKL-NH2 | 265 |
| JBT0385 | | 1765 | E | Ac-FQSKKNNFVFGYFERLRAKL-NH2 | 672 |
| JBT0386 | 42 | 526 | D | Ac-FQSKKNPFVFGYFERLRAKL-NH2 | 415 |
| JBT0388 | | 51 | B | Ac-FQSKKNVHVFGYFERLRAKL-NH2 | 192 |
| JBT0389 | | 1165 | E | Ac-FQSKKNVVVFGYFERLRAKL-NH2 | 673 |
| JBT0390 | | 1393 | E | Ac-FQSKKNVFQFGYFERLRAKL-NH2 | 674 |
| JBT0391 | 22 | 107 | C | Ac-FQSKKNVFVGGYFERLRAKL-NH2 | 266 |
| JBT0392 | | 32 | A | Ac-FQSKKNVFVHGYFERLRAKL-NH2 | 23 |
| JBT0393 | 87 | 56 | B | Ac-FQSKKNVFVKGYFERLRAKL-NH2 | 193 |
| JBT0394 | | 48 | A | Ac-FQSKKNVFVMGYFERLRAKL-NH2 | 24 |
| JBT0395 | | 31 | A | Ac-FQSKKNVFVNGYFERLRAKL-NH2 | 25 |
| JBT0396 | 28 | 80 | B | Ac-FQSKKNVFVPGYFERLRAKL-NH2 | 194 |
| JBT0397 | | 69 | B | Ac-FQSKKNVFVRGYFERLRAKL-NH2 | 195 |
| JBT0398 | | 69 | B | Ac-FQSKKNVFVFGYFEELRAKL-NH2 | 196 |
| JBT0399 | -24 | >185<br>>5000.000<br>>5000.000<br>>5000.000 | | Ac-FQSKKNVFVFGYFELLRAKL-NH2 | 750 |

FIGURE 32D

| Object ID | % Inhibition (relative to JBT-0477) | IC50 Mean (nM] | Affinity Class | Sequence | SEQ ID NO: |
|---|---|---|---|---|---|
| JBT0400 | 40 | 216 | C | Ac-FQSKKNVFVFGYFLRLRAKL-NH2 | 267 |
| JBT0401 | | 359 | D | Ac-FQSKKNVFVFGYFERLRAVL-NH2 | 416 |
| JBT0406 | | 210 | C | Ac-Ttds-FQSKKNVFVFGYFERLRAKL-NH2 | 268 |
| JBT0471 | 93 | 29 | A | Ac-FQSKGNVFVTGYFERLRAKL-NH2 | 26 |
| JBT0472 | 96 | 38 | A | Ac-FQSKGNVFVNGYFERLRAKL-NH2 | 27 |
| JBT0473 | 106 | 39 | A | Ac-FQSKGNVFVHGYFERLRAKL-NH2 | 28 |
| JBT0474 | 100 | 27 | A | Ac-FQSKGNVFVKGYFERLRAKL-NH2 | 29 |
| JBT0475 | 106 | 25 | A | Ac-FQSKGNVFVEGYFERLRAKL-NH2 | 30 |
| JBT0476 | 56 | 23 | A | Ac-FQSKGNVFVDGYFDRLRAKL-NH2 | 31 |
| JBT0477 | 99 | 32 | A | Ac-FQSKGNVFVDGYFERLRAKL-NH2 | 32 |
| JBT0478 | | 29 | A | Ac-FQSKDNVFVTGYFERLRAKL-NH2 | 33 |
| JBT0479 | | 48 | A | Ac-FQSKDNVFVNGYFERLRAKL-NH2 | 34 |
| JBT0480 | | 35 | A | Ac-FQSKDNVFVHGYFERLRAKL-NH2 | 35 |
| JBT0481 | | 49 | A | Ac-FQSKDNVFVKGYFERLRAKL-NH2 | 36 |
| JBT0482 | | 38 | A | Ac-FQSKDNVFVEGYFERLRAKL-NH2 | 37 |
| JBT0483 | 74 | 39 | A | Ac-FQSKDNVFVDGYFERLRAKL-NH2 | 38 |
| JBT0485 | | 23 | A | Ac-FQSKNNVFVTGYFERLRAKL-NH2 | 39 |
| JBT0486 | | 40 | A | Ac-FQSKNNVFVNGYFERLRAKL-NH2 | 40 |
| JBT0487 | | 40 | A | Ac-FQSKNNVFVHGYFERLRAKL-NH2 | 41 |
| JBT0488 | | 29 | A | Ac-FQSKNNVFVKGYFERLRAKL-NH2 | 42 |
| JBT0489 | | 30 | A | Ac-FQSKNNVFVEGYFERLRAKL-NH2 | 43 |
| JBT0490 | | 42 | A | Ac-FQSKQNVFVTGYFERLRAKL-NH2 | 44 |
| JBT0491 | | 59 | B | Ac-FQSKQNVFVNGYFERLRAKL-NH2 | 197 |
| JBT0492 | | 68 | B | Ac-FQSKQNVFVHGYFERLRAKL-NH2 | 198 |
| JBT0493 | | 86 | B | Ac-FQSKQNVFVKGYFERLRAKL-NH2 | 199 |

FIGURE 32E

| Object ID | % Inhibition (relative to JBT-0477) | IC50 Mean (nM] | Affinity Class | Sequence | SEQ ID NO: |
|---|---|---|---|---|---|
| JBT0494 | 74 | 48 | A | Ac-FQSKQNVFVDGYFERLRAKL-NH2 | 45 |
| JBT0495 | | 52 | B | Ac-FQSKQNVFVEGYFERLRAKL-NH2 | 200 |
| JBT0497 | | 100 | B | Ac-Nmf-QSKGNVFVFGYFERLRAKL-NH2 | 201 |
| JBT0498 | | 1512 | E | Ac-FQ-Nms-KGNVFVFGYFERLRAKL-NH2 | 675 |
| JBT0499 | | 74 | B | Ac-FQS-Nmk-GNVFVFGYFERLRAKL-NH2 | 202 |
| JBT0500 | | 24 | A | Ac-FQSK-Nmg-NVFVFGYFERLRAKL-NH2 | 46 |
| JBT0501 | | 267 | D | Ac-FQSKGN-Nmv-FVFGYFERLRAKL-NH2 | 417 |
| JBT0502 | | >5000 | | Ac-FQSKGNV-Nmf-VFGYFERLRAKL-NH2 | 751 |
| JBT0503 | | 2038 | E | Ac-FQSKGNVF-Nmv-FGYFERLRAKL-NH2 | 676 |
| JBT0504 | | 861 | D | Ac-FQSKGNVFV-Nmf-GYFERLRAKL-NH2 | 418 |
| JBT0505 | | 118 | C | Ac-FQSKGNVFVF-Nmg-YFERLRAKL-NH2 | 269 |
| JBT0506 | | 3106 | F | Ac-FQSKGNVFVFG-Nmy-FERLRAKL-NH2 | 714 |
| JBT0507 | | 2091 | E | Ac-FQSKGNVFVFGY-Nmf-ERLRAKL-NH2 | 677 |
| JBT0508 | | 1192 | E | Ac-FQSKGNVFVFGYF-Nme-RLRAKL-NH2 | 678 |
| JBT0509 | | >5000 | | Ac-FQSKGNVFVFGYFE-Nmr-LRAKL-NH2 | 752 |
| JBT0510 | | >5000 | | Ac-FQSKGNVFVFGYFER-Nml-RAKL-NH2 | 753 |
| JBT0511 | | >5000 | | Ac-FQSKGNVFVFGYFERL-Nmr-AKL-NH2 | 754 |
| JBT0512 | | 2218 | E | Ac-FQSKGNVFVFGYFERLR-Nma-KL-NH2 | 679 |
| JBT0513 | | >5000 | | Ac-FQSKGNVFVFGYFERLRA-Nmk-L-NH2 | 755 |
| JBT0514 | | 891 | D | Ac-FQSKGNVFVFGYFERLRAK-Nml-NH2 | 419 |
| JBT0515 | | 366 | D | Ac-Bhf-QSKGNVFVFGYFERLRAKL-NH2 | 420 |
| JBT0516 | | 1191 | E | Ac-F-Bhq-SKGNVFVFGYFERLRAKL-NH2 | 680 |
| JBT0517 | | 781 | D | Ac-FQ-Bhs-KGNVFVFGYFERLRAKL-NH2 | 421 |
| JBT0518 | | 767 | D | Ac-FQS-Bhk-GNVFVFGYFERLRAKL-NH2 | 422 |
| JBT0519 | | 207 | C | Ac-FQSK-Bal-NVFVFGYFERLRAKL-NH2 | 270 |

FIGURE 32F

| Object ID | % Inhibition (relative to JBT-0477) | IC50 Mean (nM] | Affinity Class | Sequence | SEQ ID NO: |
|---|---|---|---|---|---|
| JBT0520 | | 188 | C | Ac-FQSKG-Btq-VFVFGYFERLRAKL-NH2 | 271 |
| JBT0521 | | >5000 | | Ac-FQSKGN-Btl-FVFGYFERLRAKL-NH2 | 756 |
| JBT0522 | | 1424 | E | Ac-FQSKGNV-Bhf-VFGYFERLRAKL-NH2 | 681 |
| JBT0523 | | >5000 | | Ac-FQSKGNVF-Btl-FGYFERLRAKL-NH2 | 757 |
| JBT0524 | | 1573 | E | Ac-FQSKGNVFV-Bhf-GYFERLRAKL-NH2 | 682 |
| JBT0525 | | >5000 | | Ac-FQSKGNVFVF-Bal-YFERLRAKL-NH2 | 758 |
| JBT0526 | | >5000 | | Ac-FQSKGNVFVFG-Bhy-FERLRAKL-NH2 | 759 |
| JBT0527 | | 1348 | E | Ac-FQSKGNVFVFGY-Bhf-ERLRAKL-NH2 | 683 |
| JBT0528 | | 107 | C | Ac-FQSKGNVFVFGYF-Bte-RLRAKL-NH2 | 272 |
| JBT0529 | | >5000 | | Ac-FQSKGNVFVFGYFE-Bhr-LRAKL-NH2 | 760 |
| JBT0530 | | 1684 | E | Ac-FQSKGNVFVFGYFER-Bhl-RAKL-NH2 | 684 |
| JBT0531 | | 93 | B | Ac-FQSKGNVFVFGYFERL-Bhr-AKL-NH2 | 203 |
| JBT0532 | | 334 | D | Ac-FQSKGNVFVFGYFERLR-Bal-KL-NH2 | 423 |
| JBT0533 | | 756 | D | Ac-FQSKGNVFVFGYFERLRA-Bhk-L-NH2 | 424 |
| JBT0534 | | 84 | B | Ac-FQSKGNVFVFGYFERLRAK-Bhl-NH2 | 204 |
| JBT0535 | | 1779 | E | Ac-FQSKGNVFVFGYFE-Cit-LRAKL-NH2 | 685 |
| JBT0536 | | 229 | C | Ac-FQSKGNVFVFGYFERL-Cit-AKL-NH2 | 273 |
| JBT0537 | | >5000 | | Ac-FQSKGNVFVFGYFE-Nle-LRAKL-NH2 | 761 |
| JBT0538 | | 534 | D | Ac-FQSKGNVFVFGYFERL-Nle-AKL-NH2 | 425 |
| JBT0539 | -1 | 542 | D | Ac-GQSKKNVFVFGYFERLRAKL-NH2 | 426 |
| JBT0540 | 3 | 479 | D | Ac-FGSKKNVFVFGYFERLRAKL-NH2 | 427 |
| JBT0541 | 14 | 292 | D | Ac-FQGKKNVFVFGYFERLRAKL-NH2 | 428 |
| JBT0542 | 14 | 129 | C | Ac-FQSGKNVFVFGYFERLRAKL-NH2 | 274 |
| JBT0543 | 67 | 184 | C | Ac-FQSKKGVFVFGYFERLRAKL-NH2 | 275 |
| JBT0544 | -7 | 746 | D | Ac-FQSKKNGFVFGYFERLRAKL-NH2 | 429 |

FIGURE 32G

| Object ID | % Inhibition (relative to JBT-0477) | IC50 Mean (nM] | Affinity Class | Sequence | SEQ ID NO: |
|---|---|---|---|---|---|
| JBT0545 | -19 | 1780 | E | Ac-FQSKKNVGVFGYFERLRAKL-NH2 | 686 |
| JBT0546 | -15 | >5000 | | Ac-FQSKKNVFGFGYFERLRAKL-NH2 | 762 |
| JBT0547 | -18 | >5000 | | Ac-FQSKKNVFVFGGFERLRAKL-NH2 | 763 |
| JBT0548 | 4 | 885 | D | Ac-FQSKKNVFVFGYGERLRAKL-NH2 | 430 |
| JBT0549 | 35 | 572 | D | Ac-FQSKKNVFVFGYFGRLRAKL-NH2 | 431 |
| JBT0550 | -14 | >5000 | | Ac-FQSKKNVFVFGYFEGLRAKL-NH2 | 764 |
| JBT0551 | -22 | 1640 | E | Ac-FQSKKNVFVFGYFERGRAKL-NH2 | 687 |
| JBT0552 | 10 | 591 | D | Ac-FQSKKNVFVFGYFERLRGKL-NH2 | 432 |
| JBT0553 | -19 | 1101 | E | Ac-FQSKKNVFVFGYFERLRAGL-NH2 | 688 |
| JBT0554 | -5 | 314 | D | Ac-FQSKKNVFVFGYFERLRAKG-NH2 | 433 |
| JBT0555 | 8 | 350 | D | Ac-KQSKKNVFVFGYFERLRAKL-NH2 | 434 |
| JBT0556 | 2 | 336 | D | Ac-FKSKKNVFVFGYFERLRAKL-NH2 | 435 |
| JBT0557 | 27 | 245 | C | Ac-FQKKKNVFVFGYFERLRAKL-NH2 | 276 |
| JBT0558 | 44 | 125 | C | Ac-FQSKKKVFVFGYFERLRAKL-NH2 | 277 |
| JBT0559 | 23 | 203 | C | Ac-FQSKKNKFVFGYFERLRAKL-NH2 | 278 |
| JBT0560 | 2 | 688 | D | Ac-FQSKKNVKVFGYFERLRAKL-NH2 | 436 |
| JBT0561 | 7 | 653 | D | Ac-FQSKKNVFKFGYFERLRAKL-NH2 | 437 |
| JBT0562 | 10 | 413 | D | Ac-FQSKKNVFVFKYFERLRAKL-NH2 | 438 |
| JBT0563 | -6 | 1151 | E | Ac-FQSKKNVFVFGKFERLRAKL-NH2 | 689 |
| JBT0564 | 69 | 95 | B | Ac-FQSKKNVFVFGYFKRLRAKL-NH2 | 205 |
| JBT0565 | -5 | 383 | D | Ac-FQSKKNVFVFGYFEKLRAKL-NH2 | 439 |
| JBT0566 | -7 | 3310 | F | Ac-FQSKKNVFVFGYFERKRAKL-NH2 | 715 |
| JBT0567 | 51 | 225 | C | Ac-FQSKKNVFVFGYFERLKAKL-NH2 | 279 |
| JBT0568 | 49 | 147 | C | Ac-FQSKKNVFVFGYFERLRKKL-NH2 | 280 |
| JBT0569 | 13 | | | Ac-FQSKKNVFVFGYFERLRAKK-NH2 | 765 |

FIGURE 32H

| Object ID | % Inhibition (relative to JBT-0477) | IC50 Mean (nM] | Affinity Class | Sequence | SEQ ID NO: |
|---|---|---|---|---|---|
| JBT0570 | 4 | >5000 | | Ac-FFSKKNVFVFGYFERLRAKL-NH2 | 766 |
| JBT0571 | 4 | >5000 | | Ac-FQFKKNVFVFGYFERLRAKL-NH2 | 767 |
| JBT0572 | 12 | >5000 | | Ac-FQSFKNVFVFGYFERLRAKL-NH2 | 768 |
| JBT0573 | 5 | 1370 | E | Ac-FQSKFNVFVFGYFERLRAKL-NH2 | 690 |
| JBT0574 | -8 | >5000 | | Ac-FQSKKFVFVFGYFERLRAKL-NH2 | 769 |
| JBT0575 | 3 | 578 | D | Ac-FQSKKNFFVFGYFERLRAKL-NH2 | 440 |
| JBT0576 | 12 | >1666 | | Ac-FQSKKNVFVFFYFERLRAKL-NH2 | 770 |
| JBT0577 | 14 | >5000 | | Ac-FQSKKNVFVFGFFERLRAKL-NH2 | 771 |
| JBT0578 | 58 | 292 | D | Ac-FQSKKNVFVFGYFFRLRAKL-NH2 | 441 |
| JBT0579 | 4 | >5000 | | Ac-FQSKKNVFVFGYFEFLRAKL-NH2 | 772 |
| JBT0580 | 12 | >5000 | | Ac-FQSKKNVFVFGYFERFRAKL-NH2 | 773 |
| JBT0581 | 17 | >5000 | | Ac-FQSKKNVFVFGYFERLFAKL-NH2 | 774 |
| JBT0582 | 45 | >5000 | E | Ac-FQSKKNVFVFGYFERLRFKL-NH2 | 691 |
| JBT0583 | 13 | >5000 | | Ac-FQSKKNVFVFGYFERLRAFL-NH2 | 775 |
| JBT0584 | 50 | 401 | D | Ac-FQSKKNVFVFGYFERLRAKF-NH2 | 442 |
| JBT0585 | 10 | 609 | D | Ac-DQSKKNVFVFGYFERLRAKL-NH2 | 443 |
| JBT0586 | 5 | >1667 | | Ac-FDSKKNVFVFGYFERLRAKL-NH2 | 776 |
| JBT0587 | 50 | 172 | C | Ac-FQDKKNVFVFGYFERLRAKL-NH2 | 281 |
| JBT0588 | 5 | >5000 | | Ac-FQSDKNVFVFGYFERLRAKL-NH2 | 777 |
| JBT0589 | 58 | 241 | C | Ac-FQSKKDVFVFGYFERLRAKL-NH2 | 282 |
| JBT0590 | 2 | >5000 | | Ac-FQSKKNDFVFGYFERLRAKL-NH2 | 778 |
| JBT0591 | 1 | >5000 | | Ac-FQSKKNVDVFGYFERLRAKL-NH2 | 779 |
| JBT0592 | -1 | >5000 | | Ac-FQSKKNVFDFGYFERLRAKL-NH2 | 780 |
| JBT0593 | 6 | 2982 | F | Ac-FQSKKNVFVFDYFERLRAKL-NH2 | 716 |
| JBT0594 | -1 | >5000 | | Ac-FQSKKNVFVFGDFERLRAKL-NH2 | 781 |

FIGURE 32I

| Object ID | % Inhibition (relative to JBT-0477) | IC50 Mean (nM] | Affinity Class | Sequence | SEQ ID NO: |
|---|---|---|---|---|---|
| JBT0595 | 10 | 3557 | F | Ac-FQSKKNVFVFGYDERLRAKL-NH2 | 717 |
| JBT0596 | 1 | 549 | D | Ac-FQSKKNVFVFGYFEDLRAKL-NH2 | 444 |
| JBT0597 | -5 | >5000 | | Ac-FQSKKNVFVFGYFERDRAKL-NH2 | 782 |
| JBT0598 | -2 | >5000 | | Ac-FQSKKNVFVFGYFERLDAKL-NH2 | 783 |
| JBT0599 | 30 | 301 | D | Ac-FQSKKNVFVFGYFERLRDKL-NH2 | 445 |
| JBT0600 | -12 | 3232 | F | Ac-FQSKKNVFVFGYFERLRADL-NH2 | 718 |
| JBT0601 | -1 | 1531 | E | Ac-LQSKKNVFVFGYFERLRAKL-NH2 | 692 |
| JBT0602 | 8 | >1000<br>>1000<br>>5000.000 | | Ac-FLSKKNVFVFGYFERLRAKL-NH2 | 784 |
| JBT0603 | 4 | >5000 | | Ac-FQLKKNVFVFGYFERLRAKL-NH2 | 785 |
| JBT0604 | 11 | >1668 | | Ac-FQSLKNVFVFGYFERLRAKL-NH2 | 786 |
| JBT0605 | 18 | >1669 | | Ac-FQSKLNVFVFGYFERLRAKL-NH2 | 787 |
| JBT0606 | 1 | >5000 | | Ac-FQSKKLVFVFGYFERLRAKL-NH2 | 788 |
| JBT0607 | 19 | 718 | D | Ac-FQSKKNLFVFGYFERLRAKL-NH2 | 446 |
| JBT0608 | 4 | 2673 | F | Ac-FQSKKNVLVFGYFERLRAKL-NH2 | 719 |
| JBT0609 | 0 | >5000 | | Ac-FQSKKNVFLFGYFERLRAKL-NH2 | 789 |
| JBT0610 | -4 | >5000 | | Ac-FQSKKNVFVFLYFERLRAKL-NH2 | 790 |
| JBT0611 | -5 | >5000 | | Ac-FQSKKNVFVFGLFERLRAKL-NH2 | 791 |
| JBT0612 | 9 | 1378 | E | Ac-FQSKKNVFVFGYLERLRAKL-NH2 | 693 |
| JBT0613 | | 237 | C | Ac-FQSKGNVFVFGYFERLRAKL-OH | 283 |
| JBT0614 | | 2575 | F | H-FQSKGNVFVFGYFERLRAKL-OH | 720 |
| JBT0615 | | 249 | C | H-FQSKGNVFVFGYFERLRAKL-NH2 | 284 |
| JBT0616 | | 124 | C | H-GSFQSKKNVFVDGYFERLRAKL-OH | 285 |
| JBT0636 | | 24 | A | Ac-FQSK-Nmg-NVFVDGYFARLRAKL-NH2 | 47 |

FIGURE 32J

| Object ID | % Inhibition (relative to JBT-0477) | IC50 Mean (nM] | Affinity Class | Sequence | SEQ ID NO: |
|---|---|---|---|---|---|
| JBT0651 | | 18 | A | Ac-FQSKGNVHVKGYFERLRAKL-NH2 | 48 |
| JBT0652 | 103 | 36 | A | Ac-FQSKGNVHVDGYFERLRAKL-NH2 | 49 |
| JBT0653 | | 23 | A | Ac-FQSPGNVHVKGYFERLRAKL-NH2 | 50 |
| JBT0654 | | 16 | A | Ac-FQSPGNVHVDGYFERLRAKL-NH2 | 51 |
| JBT0655 | | 38 | A | Ac-FQSKGNIFVFGYFERLRAKL-NH2 | 52 |
| JBT0656 | | 155 | C | Ac-FQSKGNLFVFGYFERLRAKL-NH2 | 286 |
| JBT0657 | | 142 | C | Ac-FQSKGNVFIFGYFERLRAKL-NH2 | 287 |
| JBT0658 | | 1062 | E | Ac-FQSKGNVFLFGYFERLRAKL-NH2 | 694 |
| JBT0663 | | 45 | A | Ac-FQSKaNVFVFGYFERLRAKL-NH2 | 53 |
| JBT0668 | | 49 | A | Ac-FQSKaNVFVTGYFARLRAKL-NH2 | 54 |
| JBT0681 | | 68 | B | Ac-FQSK-Nmg-AVFVFGYFARLRAKL-NH2 | 206 |
| JBT0683 | | 25 | A | Ac-FQSK-Nmg-AVFVDGYFARLRAKL-NH2 | 55 |
| JBT0691 | 32 | | F | Ac-AQSKKNVFVFGYFERLRAKL-NH2 | 721 |
| JBT0692 | 49 | | E | Ac-FASKKNVFVFGYFERLRAKL-NH2 | 695 |
| JBT0693 | 60 | | D | Ac-FQAKKNVFVFGYFERLRAKL-NH2 | 447 |
| JBT0694 | 58 | | D | Ac-FQSAKNVFVFGYFERLRAKL-NH2 | 448 |
| JBT0695 | 52 | | D | Ac-FQSKANVFVFGYFERLRAKL-NH2 | 449 |
| JBT0696 | 94 | 101 | C | Ac-FQSKKAVFVFGYFERLRAKL-NH2 | 288 |
| JBT0697 | | 47 | A | Ac-FQSKGNVFVDGYFERL-Dap-AKL-NH2 | 56 |
| JBT0698 | -1 | | | Ac-FQSKKNVAVFGYFERLRAKL-NH2 | 792 |
| JBT0699 | | 37 | A | Ac-FQSKGNVFVDGYFERL-Orn-AKL-NH2 | 57 |
| JBT0700 | | 26 | A | Ac-FQSKGNVFVDGYFERL-Nva-AKL-NH2 | 58 |
| JBT0701 | 29 | | | Ac-FQSKKNVFVFAYFERLRAKL-NH2 | 793 |
| JBT0702 | 10 | | | Ac-FQSKKNVFVFGAFERLRAKL-NH2 | 794 |
| JBT0703 | 22 | | | Ac-FQSKKNVFVFGYAERLRAKL-NH2 | 795 |

FIGURE 32K

| Object ID | % Inhibition (relative to JBT-0477) | IC50 Mean (nM] | Affinity Class | Sequence | SEQ ID NO: |
|---|---|---|---|---|---|
| JBT0704 | 96 | 116 | C | Ac-FQSKKNVFVFGYFARLRAKL-NH2 | 289 |
| JBT0705 | 22 | | | Ac-FQSKKNVFVFGYFEALRAKL-NH2 | 796 |
| JBT0706 | 10 | | | Ac-FQSKKNVFVFGYFERARAKL-NH2 | 797 |
| JBT0707 | 50 | 502 | D | Ac-FQSKKNVFVFGYFERLAAKL-NH2 | 450 |
| JBT0708 | | 30 | A | Ac-FQSKaNVFVAGYFERLRAKL-NH2 | 59 |
| JBT0709 | 6 | | | Ac-FQSKKNVFVFGYFERLRAAL-NH2 | 798 |
| JBT0710 | -2 | | | Ac-FQSKKNVFVFGYFERLRAKA-NH2 | 799 |
| JBT0711 | 2 | | | Ac-PQSKKNVFVFGYFERLRAKL-NH2 | 800 |
| JBT0712 | 19 | | | Ac-FPSKKNVFVFGYFERLRAKL-NH2 | 801 |
| JBT0713 | 5 | 679 | D | Ac-FQPKKNVFVFGYFERLRAKL-NH2 | 451 |
| JBT0714 | | 23 | A | Ac-FQSKaAVFVDGYFARLRAKL-NH2 | 60 |
| JBT0715 | 40 | | F | Ac-FQSKPNVFVFGYFERLRAKL-NH2 | 722 |
| JBT0716 | 42 | | E | Ac-FQSKKPVFVFGYFERLRAKL-NH2 | 696 |
| JBT0717 | | 24 | A | Ac-FQSK-Nmg-NVFVDGYFERLRAKL-NH2 | 61 |
| JBT0718 | 14 | | | Ac-FQSKKNVPVFGYFERLRAKL-NH2 | 802 |
| JBT0719 | 31 | | F | Ac-FQSKKNVFPFGYFERLRAKL-NH2 | 723 |
| JBT0720 | | 27 | A | Ac-FQSK-Nmg-NVFVTGYFARLRAKL-NH2 | 62 |
| JBT0721 | 29 | | | Ac-FQSKKNVFVFPYFERLRAKL-NH2 | 803 |
| JBT0722 | 12 | | | Ac-FQSKKNVFVFGPFERLRAKL-NH2 | 804 |
| JBT0723 | 3 | | | Ac-FQSKKNVFVFGYPERLRAKL-NH2 | 805 |
| JBT0724 | 50 | | D | Ac-FQSKKNVFVFGYFPRLRAKL-NH2 | 452 |
| JBT0725 | 21 | | | Ac-FQSKKNVFVFGYFEPLRAKL-NH2 | 806 |
| JBT0726 | 2 | | D | Ac-FQSKKNVFVFGYFERPRAKL-NH2 | 453 |
| JBT0727 | -1 | | | Ac-FQSKKNVFVFGYFERLPAKL-NH2 | 807 |
| JBT0728 | 12 | | | Ac-FQSKKNVFVFGYFERLRPKL-NH2 | 808 |

FIGURE 32L

| Object ID | % Inhibition (relative to JBT-0477) | IC50 Mean (nM] | Affinity Class | Sequence | SEQ ID NO: |
|---|---|---|---|---|---|
| JBT0729 | 4 | | | Ac-FQSKKNVFVFGYFERLRAPL-NH2 | 809 |
| JBT0730 | 3 | | D | Ac-FQSKKNVFVFGYFERLRAKP-NH2 | 454 |
| JBT0731 | 21 | | | Ac-SQSKKNVFVFGYFERLRAKL-NH2 | 810 |
| JBT0732 | | 20 | A | Ac-FQSKGNVFVDGYFERL-Hci-AKL-NH2 | 63 |
| JBT0733 | | 26 | A | Ac-FQSKGNVFVDGYFERL-Har-AKL-NH2 | 64 |
| JBT0734 | 26 | | D | Ac-FQSSKNVFVFGYFERLRAKL-NH2 | 455 |
| JBT0735 | 19 | | | Ac-FQSKSNVFVFGYFERLRAKL-NH2 | 811 |
| JBT0736 | 68 | | D | Ac-FQSKKSVFVFGYFERLRAKL-NH2 | 456 |
| JBT0737 | 34 | | F | Ac-FQSKKNSFVFGYFERLRAKL-NH2 | 724 |
| JBT0738 | 20 | | | Ac-FQSKKNVSVFGYFERLRAKL-NH2 | 812 |
| JBT0739 | | 31 | A | Ac-FQSKGNVFVDGYFERL-Opa-AKL-NH2 | 65 |
| JBT0740 | 113 | 18 | A | Ac-FQSKGNVFVDGYFERL-Aib-AKL-NH2 | 66 |
| JBT0741 | 44 | | E | Ac-FQSKKNVFVFSYFERLRAKL-NH2 | 697 |
| JBT0742 | 12 | | | Ac-FQSKKNVFVFGSFERLRAKL-NH2 | 813 |
| JBT0743 | 5 | | | Ac-FQSKKNVFVFGYSERLRAKL-NH2 | 814 |
| JBT0744 | 66 | | D | Ac-FQSKKNVFVFGYFSRLRAKL-NH2 | 457 |
| JBT0745 | 9 | | | Ac-FQSKKNVFVFGYFESLRAKL-NH2 | 815 |
| JBT0746 | -1 | | | Ac-FQSKKNVFVFGYFERSRAKL-NH2 | 816 |
| JBT0747 | 19 | | | Ac-FQSKKNVFVFGYFERLSAKL-NH2 | 817 |
| JBT0748 | 43 | | D | Ac-FQSKKNVFVFGYFERLRSKL-NH2 | 458 |
| JBT0749 | 19 | | D | Ac-FQSKKNVFVFGYFERLRASL-NH2 | 459 |
| JBT0750 | 10 | | | Ac-FQSKKNVFVFGYFERLRAKS-NH2 | 818 |
| JBT0751 | 33 | | F | Ac-FQSKKNVFVFGYFERLLAKL-NH2 | 725 |
| JBT0752 | 46 | | E | Ac-FQSKKNVFVFGYFERLRLKL-NH2 | 698 |
| JBT0753 | 26 | | D | Ac-FQSKKNVFVFGYFERLRALL-NH2 | 460 |

FIGURE 32M

| Object ID | % Inhibition (relative to JBT-0477) | IC50 Mean (nM] | Affinity Class | Sequence | SEQ ID NO: |
|---|---|---|---|---|---|
| JBT0754 | | 33 | A | Ac-FQSK-Nmg-AVFVTGYFARLRAKL-NH2 | 67 |
| JBT0755 | 34 | >5000 | F | Ac-fQSKKNVFVFGYFERLRAKL-NH2 | 726 |
| JBT0756 | 35 | >5000 | F | Ac-FqSKKNVFVFGYFERLRAKL-NH2 | 727 |
| JBT0757 | | 2212 | E | Ac-FQsKKNVFVFGYFERLRAKL-NH2 | 699 |
| JBT0758 | 52 | 101 | C | Ac-FQSkKNVFVFGYFERLRAKL-NH2 | 290 |
| JBT0759 | 78 | 52 | B | Ac-FQSKkNVFVFGYFERLRAKL-NH2 | 207 |
| JBT0760 | 37 | | F | Ac-FQSKKnVFVFGYFERLRAKL-NH2 | 728 |
| JBT0761 | 35 | | F | Ac-FQSKKNvFVFGYFERLRAKL-NH2 | 729 |
| JBT0762 | 37 | | F | Ac-FQSKKNVfVFGYFERLRAKL-NH2 | 730 |
| JBT0763 | 58 | 129 | C | Ac-FQSKKNVFfFGYFERLRAKL-NH2 | 291 |
| JBT0764 | 53 | 296 | D | Ac-FQSKKNVFVfGYFERLRAKL-NH2 | 461 |
| JBT0765 | | 26 | A | Ac-FQSKGNVFVDGYFERL-Eew-AKL-NH2 | 68 |
| JBT0766 | 32 | | D | Ac-FQSKKNVFVFGyFERLRAKL-NH2 | 462 |
| JBT0767 | 40 | | E | Ac-FQSKKNVFVFGYfERLRAKL-NH2 | 700 |
| JBT0768 | 27 | | D | Ac-FQSKKNVFVFGYFeRLRAKL-NH2 | 463 |
| JBT0769 | 22 | | D | Ac-FQSKKNVFVFGYFErLRAKL-NH2 | 464 |
| JBT0770 | 20 | | | Ac-FQSKKNVFVFGYFERlRAKL-NH2 | 819 |
| JBT0771 | 29 | 423 | D | Ac-FQSKKNVFVFGYFERLrAKL-NH2 | 465 |
| JBT0772 | 21 | | | Ac-FQSKKNVFVFGYFERLRaKL-NH2 | 820 |
| JBT0773 | 21 | | | Ac-FQSKKNVFVFGYFERLRAkL-NH2 | 821 |
| JBT0774 | 26 | | | Ac-FQSKKNVFVFGYFERLRAKl-NH2 | 822 |
| JBT0775 | 73 | 22 | A | Ac-FQSKGNVFVTGYFDRLRAKL-NH2 | 69 |
| JBT0776 | 51 | 82 | B | Ac-FQSKGNVFVNGYFDRLRAKL-NH2 | 208 |
| JBT0777 | 49 | 101 | C | Ac-FQSKGNVFVHGYFDRLRAKL-NH2 | 292 |
| JBT0778 | 68 | 66 | B | Ac-FQSKGNVFVKGYFDRLRAKL-NH2 | 209 |

FIGURE 32N

| Object ID | % Inhibition (relative to JBT-0477) | IC50 Mean (nM] | Affinity Class | Sequence | SEQ ID NO: |
|---|---|---|---|---|---|
| JBT0779 | 51 | 71 | B | Ac-FQSKGNVFVEGYFDRLRAKL-NH2 | 210 |
| JBT0780 | | 44 | A | Ac-FQSK-Nmg-NVFVFGYFARLRAKL-NH2 | 70 |
| JBT0781 | 82 | 63 | B | Ac-FQSKGNVFVDGYFKRLRAKL-NH2 | 211 |
| JBT0782 | 44 | >556<br>>555.556 | D | Ac-fqskknvfvfgyferlrakl-NH2 | 466 |
| JBT0783 | 39 | >556<br>>1666.670 | D | Ac-lkarlrefygfvfvnkksqf-NH2 | 467 |
| JBT0784 | | >5000 | | Ac-FQSKKNVFVFGYFE-(omega-methyl-R)-L-(omega-methyl-R)-AKL-NH2 | 823 |
| JBT0785 | | 163 | C | Ac-FQSKKNVFVFGYFERL-(omega-methyl-R)-AKL-NH2 | 293 |
| JBT0786 | | 616 | D | Ac-FQSKKNVFVFGYFE-(omega-methyl-R)-LRAKL-NH2 | 468 |
| JBT0789 | | 20 | A | Ac-FQSK-Nmg-NVFVDGYFERL-Nle-AKL-NH2 | 71 |
| JBT0791 | 42 | | D | Ac-AQSKGNVFVDGYFERLRAKL-NH2 | 469 |
| JBT0792 | 5 | | D | Ac-FASKGNVFVDGYFERLRAKL-NH2 | 470 |
| JBT0793 | 88 | | C | Ac-FQAKGNVFVDGYFERLRAKL-NH2 | 294 |
| JBT0794 | 90 | 156 | C | Ac-FQSAGNVFVDGYFERLRAKL-NH2 | 295 |
| JBT0795 | 92 | 34 | A | Ac-FQSKGAVFVDGYFERLRAKL-NH2 | 72 |
| JBT0796 | 70 | | D | Ac-FQSKGNAFVDGYFERLRAKL-NH2 | 471 |
| JBT0797 | -2 | | | Ac-FQSKGNVAVDGYFERLRAKL-NH2 | 824 |
| JBT0798 | 39 | | F | Ac-FQSKGNVFADGYFERLRAKL-NH2 | 731 |
| JBT0799 | 8 | | | Ac-FQSKGNVFVDAYFERLRAKL-NH2 | 825 |
| JBT0800 | -2 | | | Ac-FQSKGNVFVDGAFERLRAKL-NH2 | 826 |
| JBT0801 | 64 | | D | Ac-FQSKGNVFVDGYAERLRAKL-NH2 | 472 |
| JBT0802 | 101 | 35 | A | Ac-FQSKGNVFVDGYFARLRAKL-NH2 | 73 |
| JBT0803 | 7 | | D | Ac-FQSKGNVFVDGYFEALRAKL-NH2 | 473 |
| JBT0804 | 10 | | | Ac-FQSKGNVFVDGYFERARAKL-NH2 | 827 |

FIGURE 32O

| Object ID | % Inhibition (relative to JBT-0477) | IC50 Mean (nM] | Affinity Class | Sequence | SEQ ID NO: |
|---|---|---|---|---|---|
| JBT0805 | 98 | 64 | B | Ac-FQSKGNVFVDGYFERLAAKL-NH2 | 212 |
| JBT0806 | | 42 | A | Ac-FQSK-Nmg-NVFVAGYFARLRAKL-NH2 | 74 |
| JBT0807 | -6 | | | Ac-FQSKGNVFVDGYFERLRAAL-NH2 | 828 |
| JBT0808 | 39 | | F | Ac-FQSKGNVFVDGYFERLRAKA-NH2 | 732 |
| JBT0809 | 10 | | | Ac-DQSKGNVFVDGYFERLRAKL-NH2 | 829 |
| JBT0810 | -1 | | | Ac-FDSKGNVFVDGYFERLRAKL-NH2 | 830 |
| JBT0811 | 69 | | D | Ac-FQDKGNVFVDGYFERLRAKL-NH2 | 474 |
| JBT0812 | 81 | | C | Ac-FQSDGNVFVDGYFERLRAKL-NH2 | 296 |
| JBT0813 | 76 | | D | Ac-FQSKGDVFVDGYFERLRAKL-NH2 | 475 |
| JBT0814 | 4 | | | Ac-FQSKGNDFVDGYFERLRAKL-NH2 | 831 |
| JBT0815 | 2 | | | Ac-FQSKGNVDVDGYFERLRAKL-NH2 | 832 |
| JBT0816 | 1 | | | Ac-FQSKGNVFDDGYFERLRAKL-NH2 | 833 |
| JBT0817 | 5 | | | Ac-FQSKGNVFVDDYFERLRAKL-NH2 | 834 |
| JBT0818 | 3 | | D | Ac-FQSKGNVFVDGDFERLRAKL-NH2 | 476 |
| JBT0819 | 31 | | D | Ac-FQSKGNVFVDGYDERLRAKL-NH2 | 477 |
| JBT0820 | 0 | | | Ac-FQSKGNVFVDGYFEDLRAKL-NH2 | 835 |
| JBT0821 | -3 | | | Ac-FQSKGNVFVDGYFERDRAKL-NH2 | 836 |
| JBT0822 | 51 | | D | Ac-FQSKGNVFVDGYFERLDAKL-NH2 | 478 |
| JBT0823 | 82 | | C | Ac-FQSKGNVFVDGYFERLRDKL-NH2 | 297 |
| JBT0824 | 3 | | | Ac-FQSKGNVFVDGYFERLRADL-NH2 | 837 |
| JBT0825 | 9 | | | Ac-FQSKGNVFVDGYFERLRAKD-NH2 | 838 |
| JBT0826 | 22 | | D | Ac-EQSKGNVFVDGYFERLRAKL-NH2 | 479 |
| JBT0827 | -3 | | | Ac-FESKGNVFVDGYFERLRAKL-NH2 | 839 |
| JBT0828 | 90 | | C | Ac-FQEKGNVFVDGYFERLRAKL-NH2 | 298 |
| JBT0829 | 104 | | A | Ac-FQSEGNVFVDGYFERLRAKL-NH2 | 75 |

FIGURE 32P

| Object ID | % Inhibition (relative to JBT-0477) | IC50 Mean (nM] | Affinity Class | Sequence | SEQ ID NO: |
|---|---|---|---|---|---|
| JBT0830 | 75 | | D | Ac-FQSKGEVFVDGYFERLRAKL-NH2 | 480 |
| JBT0831 | 18 | | D | Ac-FQSKGNEFVDGYFERLRAKL-NH2 | 481 |
| JBT0832 | -5 | | | Ac-FQSKGNVEVDGYFERLRAKL-NH2 | 840 |
| JBT0833 | 11 | | | Ac-FQSKGNVFEDGYFERLRAKL-NH2 | 841 |
| JBT0834 | 13 | | | Ac-FQSKGNVFVDEYFERLRAKL-NH2 | 842 |
| JBT0835 | 5 | | | Ac-FQSKGNVFVDGEFERLRAKL-NH2 | 843 |
| JBT0836 | 51 | | D | Ac-FQSKGNVFVDGYEERLRAKL-NH2 | 482 |
| JBT0837 | | 87 | B | Ac-FQSK-Nmg-NVFVTGYFERL-Nle-AKL-NH2 | 213 |
| JBT0838 | 4 | | D | Ac-FQSKGNVFVDGYFEELRAKL-NH2 | 483 |
| JBT0839 | 4 | | | Ac-FQSKGNVFVDGYFERERAKL-NH2 | 844 |
| JBT0840 | 71 | | D | Ac-FQSKGNVFVDGYFERLEAKL-NH2 | 484 |
| JBT0841 | 82 | | C | Ac-FQSKGNVFVDGYFERLREKL-NH2 | 299 |
| JBT0842 | 3 | | | Ac-FQSKGNVFVDGYFERLRAEL-NH2 | 845 |
| JBT0843 | 21 | | | Ac-FQSKGNVFVDGYFERLRAKE-NH2 | 846 |
| JBT0844 | | 112 | C | Ac-FQSKaNVFVDGYFERLRAKL-NH2 | 300 |
| JBT0845 | 5 | | D | Ac-FFSKGNVFVDGYFERLRAKL-NH2 | 485 |
| JBT0846 | 66 | | D | Ac-FQFKGNVFVDGYFERLRAKL-NH2 | 486 |
| JBT0847 | 82 | | C | Ac-FQSFGNVFVDGYFERLRAKL-NH2 | 301 |
| JBT0848 | 69 | | D | Ac-FQSKGFVFVDGYFERLRAKL-NH2 | 487 |
| JBT0849 | 48 | | D | Ac-FQSKGNFFVDGYFERLRAKL-NH2 | 488 |
| JBT0850 | | 150 | C | Ac-FQSKaAVFVAGYFARLRAKL-NH2 | 302 |
| JBT0851 | 6 | | D | Ac-FQSKGNVFFDGYFERLRAKL-NH2 | 489 |
| JBT0852 | 18 | | | Ac-FQSKGNVFVDFYFERLRAKL-NH2 | 847 |
| JBT0853 | 13 | | | Ac-FQSKGNVFVDGFFERLRAKL-NH2 | 848 |
| JBT0854 | | 593 | D | Ac-FQSKaAVFVAGYFARL-Nle-AKL-NH2 | 490 |

FIGURE 32Q

| Object ID | % Inhibition (relative to JBT-0477) | IC50 Mean (nM] | Affinity Class | Sequence | SEQ ID NO: |
|---|---|---|---|---|---|
| JBT0855 | 57 | | D | Ac-FQSKGNVFVDGYFFRLRAKL-NH2 | 491 |
| JBT0856 | 4 | | D | Ac-FQSKGNVFVDGYFEFLRAKL-NH2 | 492 |
| JBT0857 | 13 | | | Ac-FQSKGNVFVDGYFERFRAKL-NH2 | 849 |
| JBT0858 | 85 | | C | Ac-FQSKGNVFVDGYFERLFAKL-NH2 | 303 |
| JBT0859 | 81 | | C | Ac-FQSKGNVFVDGYFERLRFKL-NH2 | 304 |
| JBT0860 | 1 | | | Ac-FQSKGNVFVDGYFERLRAFL-NH2 | 850 |
| JBT0861 | 94 | | C | Ac-FQSKGNVFVDGYFERLRAKF-NH2 | 305 |
| JBT0862 | 23 | | | Ac-GQSKGNVFVDGYFERLRAKL-NH2 | 851 |
| JBT0863 | 7 | | D | Ac-FGSKGNVFVDGYFERLRAKL-NH2 | 493 |
| JBT0864 | 60 | | D | Ac-FQGKGNVFVDGYFERLRAKL-NH2 | 494 |
| JBT0865 | 69 | | D | Ac-FQSGGNVFVDGYFERLRAKL-NH2 | 495 |
| JBT0866 | 79 | | D | Ac-FQSKGGVFVDGYFERLRAKL-NH2 | 496 |
| JBT0867 | 2 | | | Ac-FQSKGNGFVDGYFERLRAKL-NH2 | 852 |
| JBT0868 | 4 | | | Ac-FQSKGNVGVDGYFERLRAKL-NH2 | 853 |
| JBT0869 | -1 | | | Ac-FQSKGNVFGDGYFERLRAKL-NH2 | 854 |
| JBT0870 | | 57 | B | Ac-FQSKaAVFVTGYFARLRAKL-NH2 | 214 |
| JBT0871 | 1 | | | Ac-FQSKGNVFVDGGFERLRAKL-NH2 | 855 |
| JBT0872 | 24 | | D | Ac-FQSKGNVFVDGYGERLRAKL-NH2 | 497 |
| JBT0873 | 64 | | D | Ac-FQSKGNVFVDGYFGRLRAKL-NH2 | 498 |
| JBT0874 | 1 | | D | Ac-FQSKGNVFVDGYFEGLRAKL-NH2 | 499 |
| JBT0875 | -5 | | | Ac-FQSKGNVFVDGYFERGRAKL-NH2 | 856 |
| JBT0876 | 75 | | D | Ac-FQSKGNVFVDGYFERLGAKL-NH2 | 500 |
| JBT0877 | 50 | | E | Ac-FQSKGNVFVDGYFERLRGKL-NH2 | 701 |
| JBT0878 | 9 | | | Ac-FQSKGNVFVDGYFERLRAGL-NH2 | 857 |
| JBT0879 | 29 | | | Ac-FQSKGNVFVDGYFERLRAKG-NH2 | 858 |

FIGURE 32R

| Object ID | % Inhibition (relative to JBT-0477) | IC50 Mean (nM] | Affinity Class | Sequence | SEQ ID NO: |
|---|---|---|---|---|---|
| JBT0880 | 56 | | D | Ac-HQSKGNVFVDGYFERLRAKL-NH2 | 501 |
| JBT0881 | -2 | | | Ac-FHSKGNVFVDGYFERLRAKL-NH2 | 859 |
| JBT0882 | 85 | | C | Ac-FQHKGNVFVDGYFERLRAKL-NH2 | 306 |
| JBT0883 | 93 | | C | Ac-FQSHGNVFVDGYFERLRAKL-NH2 | 307 |
| JBT0884 | 71 | | D | Ac-FQSKGHVFVDGYFERLRAKL-NH2 | 502 |
| JBT0885 | 50 | | D | Ac-FQSKGNHFVDGYFERLRAKL-NH2 | 503 |
| JBT0886 | | 50 | B | Ac-FQSKaNVFVDGYFARLRAKL-NH2 | 215 |
| JBT0887 | 0 | | | Ac-FQSKGNVFHDGYFERLRAKL-NH2 | 860 |
| JBT0888 | 35 | | D | Ac-FQSKGNVFVDHYFERLRAKL-NH2 | 504 |
| JBT0889 | -8 | | | Ac-FQSKGNVFVDGHFERLRAKL-NH2 | 861 |
| JBT0890 | 71 | | D | Ac-FQSKGNVFVDGYHERLRAKL-NH2 | 505 |
| JBT0891 | 93 | | C | Ac-FQSKGNVFVDGYFHRLRAKL-NH2 | 308 |
| JBT0892 | -8 | | | Ac-FQSKGNVFVDGYFEHLRAKL-NH2 | 862 |
| JBT0893 | -10 | | | Ac-FQSKGNVFVDGYFERHRAKL-NH2 | 863 |
| JBT0894 | 103 | 42 | A | Ac-FQSKGNVFVDGYFERLHAKL-NH2 | 76 |
| JBT0895 | 69 | | D | Ac-FQSKGNVFVDGYFERLRHKL-NH2 | 506 |
| JBT0896 | -12 | | | Ac-FQSKGNVFVDGYFERLRAHL-NH2 | 864 |
| JBT0897 | 71 | | D | Ac-FQSKGNVFVDGYFERLRAKH-NH2 | 507 |
| JBT0898 | 87 | | C | Ac-IQSKGNVFVDGYFERLRAKL-NH2 | 309 |
| JBT0899 | 7 | | D | Ac-FISKGNVFVDGYFERLRAKL-NH2 | 508 |
| JBT0900 | 88 | | C | Ac-FQIKGNVFVDGYFERLRAKL-NH2 | 310 |
| JBT0901 | 96 | | A | Ac-FQSIGNVFVDGYFERLRAKL-NH2 | 77 |
| JBT0902 | 94 | | C | Ac-FQSKGIVFVDGYFERLRAKL-NH2 | 311 |
| JBT0903 | 97 | | A | Ac-FQSKGNIFVDGYFERLRAKL-NH2 | 78 |
| JBT0904 | 2 | | | Ac-FQSKGNVIVDGYFERLRAKL-NH2 | 865 |

FIGURE 32S

| Object ID | % Inhibition (relative to JBT-0477) | IC50 Mean (nM] | Affinity Class | Sequence | SEQ ID NO: |
|---|---|---|---|---|---|
| JBT0905 | 58 | | D | Ac-FQSKGNVFIDGYFERLRAKL-NH2 | 509 |
| JBT0906 | -2 | | | Ac-FQSKGNVFVDIYFERLRAKL-NH2 | 866 |
| JBT0907 | 1 | | | Ac-FQSKGNVFVDGIFERLRAKL-NH2 | 867 |
| JBT0908 | 39 | | D | Ac-FQSKGNVFVDGYIERLRAKL-NH2 | 510 |
| JBT0909 | 92 | | C | Ac-FQSKGNVFVDGYFIRLRAKL-NH2 | 312 |
| JBT0910 | 0 | | | Ac-FQSKGNVFVDGYFEILRAKL-NH2 | 868 |
| JBT0911 | 15 | | | Ac-FQSKGNVFVDGYFERIRAKL-NH2 | 869 |
| JBT0912 | 104 | 57 | B | Ac-FQSKGNVFVDGYFERLIAKL-NH2 | 216 |
| JBT0913 | 65 | | D | Ac-FQSKGNVFVDGYFERLRIKL-NH2 | 511 |
| JBT0914 | -7 | | | Ac-FQSKGNVFVDGYFERLRAIL-NH2 | 870 |
| JBT0915 | 80 | | D | Ac-FQSKGNVFVDGYFERLRAKI-NH2 | 512 |
| JBT0916 | 59 | | D | Ac-KQSKGNVFVDGYFERLRAKL-NH2 | 513 |
| JBT0917 | -3 | | | Ac-FKSKGNVFVDGYFERLRAKL-NH2 | 871 |
| JBT0918 | 65 | | D | Ac-FQKKGNVFVDGYFERLRAKL-NH2 | 514 |
| JBT0919 | | 42 | A | Ac-FQSKaNVFVTGYFERLRAKL-NH2 | 79 |
| JBT0920 | 115 | 23 | A | Ac-FQSKGKVFVDGYFERLRAKL-NH2 | 80 |
| JBT0921 | 11 | | | Ac-FQSKGNKFVDGYFERLRAKL-NH2 | 872 |
| JBT0922 | -4 | | | Ac-FQSKGNVKVDGYFERLRAKL-NH2 | 873 |
| JBT0923 | 3 | | D | Ac-FQSKGNVFKDGYFERLRAKL-NH2 | 515 |
| JBT0924 | 17 | | | Ac-FQSKGNVFVDKYFERLRAKL-NH2 | 874 |
| JBT0925 | -6 | | | Ac-FQSKGNVFVDGKFERLRAKL-NH2 | 875 |
| JBT0926 | 20 | | D | Ac-FQSKGNVFVDGYKERLRAKL-NH2 | 516 |
| JBT0927 | -8 | | | Ac-FQSKGNVFVDGYFEKLRAKL-NH2 | 876 |
| JBT0928 | 4 | | | Ac-FQSKGNVFVDGYFERKRAKL-NH2 | 877 |
| JBT0929 | 107 | 29 | A | Ac-FQSKGNVFVDGYFERLKAKL-NH2 | 81 |

FIGURE 32T

| Object ID | % Inhibition (relative to JBT-0477) | IC50 Mean (nM] | Affinity Class | Sequence | SEQ ID NO: |
|---|---|---|---|---|---|
| JBT0930 | 44 | | E | Ac-FQSKGNVFVDGYFERLRKKL-NH2 | 702 |
| JBT0931 | | 33 | A | Ac-FQSKGNVFVDGYFERL-Eag-AKL-NH2 | 82 |
| JBT0932 | 47 | | E | Ac-FQSKGNVFVDGYFERLRAKK-NH2 | 703 |
| JBT0933 | 75 | | D | Ac-LQSKGNVFVDGYFERLRAKL-NH2 | 517 |
| JBT0934 | -7 | | | Ac-FLSKGNVFVDGYFERLRAKL-NH2 | 878 |
| JBT0935 | 72 | | D | Ac-FQLKGNVFVDGYFERLRAKL-NH2 | 518 |
| JBT0936 | 97 | 41 | A | Ac-FQSLGNVFVDGYFERLRAKL-NH2 | 83 |
| JBT0937 | 90 | | C | Ac-FQSKGLVFVDGYFERLRAKL-NH2 | 313 |
| JBT0938 | 44 | | D | Ac-FQSKGNLFVDGYFERLRAKL-NH2 | 519 |
| JBT0939 | 27 | | | Ac-FQSKGNVLVDGYFERLRAKL-NH2 | 879 |
| JBT0940 | 4 | | | Ac-FQSKGNVFLDGYFERLRAKL-NH2 | 880 |
| JBT0941 | 28 | | D | Ac-FQSKGNVFVDLYFERLRAKL-NH2 | 520 |
| JBT0942 | 4 | | D | Ac-FQSKGNVFVDGLFERLRAKL-NH2 | 521 |
| JBT0943 | 83 | | C | Ac-FQSKGNVFVDGYLERLRAKL-NH2 | 314 |
| JBT0944 | 103 | | A | Ac-FQSKGNVFVDGYFLRLRAKL-NH2 | 84 |
| JBT0945 | 1 | | D | Ac-FQSKGNVFVDGYFELLRAKL-NH2 | 522 |
| JBT0946 | | 38 | A | Ac-FQSKGNVFVDGYFERL-Dab-AKL-NH2 | 85 |
| JBT0947 | 105 | | A | Ac-FQSKGNVFVDGYFERLLAKL-NH2 | 86 |
| JBT0948 | 108 | 46 | A | Ac-FQSKGNVFVDGYFERLRLKL-NH2 | 87 |
| JBT0949 | 2 | | | Ac-FQSKGNVFVDGYFERLRALL-NH2 | 881 |
| JBT0950 | | 73 | B | Ac-FQSKaNVFVFGYFARLRAKL-NH2 | 217 |
| JBT0951 | 97 | | A | Ac-MQSKGNVFVDGYFERLRAKL-NH2 | 88 |
| JBT0953 | 109 | 43 | A | Ac-FQMKGNVFVDGYFERLRAKL-NH2 | 89 |
| JBT0956 | 27 | | | Ac-FQSKGNMFVDGYFERLRAKL-NH2 | 882 |
| JBT0961 | 77 | | D | Ac-FQSKGNVFVDGYMERLRAKL-NH2 | 523 |

FIGURE 32U

| Object ID | % Inhibition (relative to JBT-0477) | IC50 Mean (nM] | Affinity Class | Sequence | SEQ ID NO: |
|---|---|---|---|---|---|
| JBT0962 | 107 | 40 | A | Ac-FQSKGNVFVDGYFMRLRAKL-NH2 | 90 |
| JBT0964 | 28 | | | Ac-FQSKGNVFVDGYFERMRAKL-NH2 | 883 |
| JBT0966 | 100 | | A | Ac-FQSKGNVFVDGYFERLRMKL-NH2 | 91 |
| JBT0969 | 65 | | D | Ac-NQSKGNVFVDGYFERLRAKL-NH2 | 524 |
| JBT0970 | 7 | | D | Ac-FNSKGNVFVDGYFERLRAKL-NH2 | 525 |
| JBT0971 | 83 | | C | Ac-FQNKGNVFVDGYFERLRAKL-NH2 | 315 |
| JBT0972 | 94 | | C | Ac-FQSNGNVFVDGYFERLRAKL-NH2 | 316 |
| JBT0973 | | 37 | A | Ac-FQSKGNVFVDGYFERL-Cha-AKL-NH2 | 92 |
| JBT0974 | 29 | | | Ac-FQSKGNNFVDGYFERLRAKL-NH2 | 884 |
| JBT0975 | -3 | | | Ac-FQSKGNVNVDGYFERLRAKL-NH2 | 885 |
| JBT0976 | -2 | | | Ac-FQSKGNVFNDGYFERLRAKL-NH2 | 886 |
| JBT0977 | 15 | | | Ac-FQSKGNVFVDNYFERLRAKL-NH2 | 887 |
| JBT0978 | -10 | | | Ac-FQSKGNVFVDGNFERLRAKL-NH2 | 888 |
| JBT0979 | 44 | | D | Ac-FQSKGNVFVDGYNERLRAKL-NH2 | 526 |
| JBT0980 | 93 | 40 | A | Ac-FQSKGNVFVDGYFNRLRAKL-NH2 | 93 |
| JBT0982 | -2 | | | Ac-FQSKGNVFVDGYFERNRAKL-NH2 | 889 |
| JBT0983 | 81 | | C | Ac-FQSKGNVFVDGYFERLNAKL-NH2 | 317 |
| JBT0984 | 100 | 34 | A | Ac-FQSKGNVFVDGYFERLRNKL-NH2 | 94 |
| JBT0985 | 4 | | | Ac-FQSKGNVFVDGYFERLRANL-NH2 | 890 |
| JBT0986 | 32 | | F | Ac-FQSKGNVFVDGYFERLRAKN-NH2 | 733 |
| JBT0987 | 27 | | | Ac-PQSKGNVFVDGYFERLRAKL-NH2 | 891 |
| JBT0988 | 0 | | | Ac-FPSKGNVFVDGYFERLRAKL-NH2 | 892 |
| JBT0989 | 5 | | | Ac-FQPKGNVFVDGYFERLRAKL-NH2 | 893 |
| JBT0990 | 106 | 33 | A | Ac-FQSPGNVFVDGYFERLRAKL-NH2 | 95 |
| JBT0991 | 5 | | | Ac-FQSKGPVFVDGYFERLRAKL-NH2 | 894 |

FIGURE 32V

| Object ID | % Inhibition (relative to JBT-0477) | IC50 Mean (nM] | Affinity Class | Sequence | SEQ ID NO: |
|---|---|---|---|---|---|
| JBT0992 | 65 | | D | Ac-FQSKGNPFVDGYFERLRAKL-NH2 | 527 |
| JBT0993 | 1 | | | Ac-FQSKGNVPVDGYFERLRAKL-NH2 | 895 |
| JBT0994 | 2 | | | Ac-FQSKGNVFPDGYFERLRAKL-NH2 | 896 |
| JBT0995 | 4 | | D | Ac-FQSKGNVFVDPYFERLRAKL-NH2 | 528 |
| JBT0996 | 3 | | | Ac-FQSKGNVFVDGPFERLRAKL-NH2 | 897 |
| JBT0997 | 8 | | D | Ac-FQSKGNVFVDGYPERLRAKL-NH2 | 529 |
| JBT0998 | 48 | | D | Ac-FQSKGNVFVDGYFPRLRAKL-NH2 | 530 |
| JBT0999 | 3 | | D | Ac-FQSKGNVFVDGYFEPLRAKL-NH2 | 531 |
| JBT1000 | 3 | | | Ac-FQSKGNVFVDGYFERPRAKL-NH2 | 898 |
| JBT1001 | 1 | | | Ac-FQSKGNVFVDGYFERLPAKL-NH2 | 899 |
| JBT1002 | 15 | | | Ac-FQSKGNVFVDGYFERLRPKL-NH2 | 900 |
| JBT1003 | 4 | | | Ac-FQSKGNVFVDGYFERLRAPL-NH2 | 901 |
| JBT1004 | 8 | | | Ac-FQSKGNVFVDGYFERLRAKP-NH2 | 902 |
| JBT1005 | 55 | | D | Ac-QQSKGNVFVDGYFERLRAKL-NH2 | 532 |
| JBT1006 | | 28 | A | Ac-FQSKGNVFVDGYFERL-Hle-AKL-NH2 | 96 |
| JBT1007 | 98 | 28 | A | Ac-FQQKGNVFVDGYFERLRAKL-NH2 | 97 |
| JBT1008 | 83 | | C | Ac-FQSQGNVFVDGYFERLRAKL-NH2 | 318 |
| JBT1009 | 99 | 38 | A | Ac-FQSKGQVFVDGYFERLRAKL-NH2 | 98 |
| JBT1010 | 46 | | D | Ac-FQSKGNQFVDGYFERLRAKL-NH2 | 533 |
| JBT1011 | 8 | | | Ac-FQSKGNVQVDGYFERLRAKL-NH2 | 903 |
| JBT1012 | 14 | | D | Ac-FQSKGNVFQDGYFERLRAKL-NH2 | 534 |
| JBT1013 | 23 | | D | Ac-FQSKGNVFVDQYFERLRAKL-NH2 | 535 |
| JBT1014 | 4 | | | Ac-FQSKGNVFVDGQFERLRAKL-NH2 | 904 |
| JBT1015 | 55 | | D | Ac-FQSKGNVFVDGYQERLRAKL-NH2 | 536 |
| JBT1016 | 102 | 27 | A | Ac-FQSKGNVFVDGYFQRLRAKL-NH2 | 99 |

FIGURE 32W

| Object ID | % Inhibition (relative to JBT-0477) | IC50 Mean (nM] | Affinity Class | Sequence | SEQ ID NO: |
|---|---|---|---|---|---|
| JBT1017 | 8 | | D | Ac-FQSKGNVFVDGYFEQLRAKL-NH2 | 537 |
| JBT1018 | 12 | | | Ac-FQSKGNVFVDGYFERQRAKL-NH2 | 905 |
| JBT1019 | 76 | | D | Ac-FQSKGNVFVDGYFERLQAKL-NH2 | 538 |
| JBT1020 | 88 | | C | Ac-FQSKGNVFVDGYFERLRQKL-NH2 | 319 |
| JBT1021 | 2 | | | Ac-FQSKGNVFVDGYFERLRAQL-NH2 | 906 |
| JBT1022 | 55 | | D | Ac-FQSKGNVFVDGYFERLRAKQ-NH2 | 539 |
| JBT1023 | 60 | | D | Ac-RQSKGNVFVDGYFERLRAKL-NH2 | 540 |
| JBT1024 | 11 | | D | Ac-FRSKGNVFVDGYFERLRAKL-NH2 | 541 |
| JBT1025 | 93 | 46 | A | Ac-FQRKGNVFVDGYFERLRAKL-NH2 | 100 |
| JBT1026 | 102 | 38 | A | Ac-FQSRGNVFVDGYFERLRAKL-NH2 | 101 |
| JBT1027 | 110 | 29 | A | Ac-FQSKGRVFVDGYFERLRAKL-NH2 | 102 |
| JBT1028 | 15 | | D | Ac-FQSKGNRFVDGYFERLRAKL-NH2 | 542 |
| JBT1029 | 18 | | D | Ac-FQSKGNVRVDGYFERLRAKL-NH2 | 543 |
| JBT1030 | 18 | | D | Ac-FQSKGNVFRDGYFERLRAKL-NH2 | 544 |
| JBT1031 | 27 | | | Ac-FQSKGNVFVDRYFERLRAKL-NH2 | 907 |
| JBT1032 | 6 | | | Ac-FQSKGNVFVDGRFERLRAKL-NH2 | 908 |
| JBT1033 | 60 | | D | Ac-FQSKGNVFVDGYRERLRAKL-NH2 | 545 |
| JBT1034 | 103 | 36 | A | Ac-FQSKGNVFVDGYFRRLRAKL-NH2 | 103 |
| JBT1035 | | 92 | B | Ac-FQSK-Nmg-AVFVAGYFARL-Nle-AKL-NH2 | 218 |
| JBT1036 | 29 | | D | Ac-FQSKGNVFVDGYFERRRAKL-NH2 | 546 |
| JBT1037 | | 27 | A | Ac-FQSKGNVFVDGYFERL-Nle-AKL-NH2 | 104 |
| JBT1038 | 107 | | A | Ac-FQSKGNVFVDGYFERLRRKL-NH2 | 105 |
| JBT1039 | 95 | | C | Ac-FQSKGNVFVDGYFERLRARL-NH2 | 320 |
| JBT1040 | 84 | | C | Ac-FQSKGNVFVDGYFERLRAKR-NH2 | 321 |
| JBT1041 | 37 | | F | Ac-SQSKGNVFVDGYFERLRAKL-NH2 | 734 |

FIGURE 32X

| Object ID | % Inhibition (relative to JBT-0477) | IC50 Mean (nM] | Affinity Class | Sequence | SEQ ID NO: |
|---|---|---|---|---|---|
| JBT1042 | 2 | | D | Ac-FSSKGNVFVDGYFERLRAKL-NH2 | 547 |
| JBT1043 | | 40 | A | Ac-FQSKaNVFVDGYFERL-Nle-AKL-NH2 | 106 |
| JBT1044 | 78 | | D | Ac-FQSSGNVFVDGYFERLRAKL-NH2 | 548 |
| JBT1045 | 109 | 50 | A | Ac-FQSKGSVFVDGYFERLRAKL-NH2 | 107 |
| JBT1046 | 57 | | D | Ac-FQSKGNSFVDGYFERLRAKL-NH2 | 549 |
| JBT1047 | 5 | | | Ac-FQSKGNVSVDGYFERLRAKL-NH2 | 909 |
| JBT1048 | 38 | | D | Ac-FQSKGNVFSDGYFERLRAKL-NH2 | 550 |
| JBT1049 | 18 | | D | Ac-FQSKGNVFVDSYFERLRAKL-NH2 | 551 |
| JBT1050 | 2 | | | Ac-FQSKGNVFVDGSFERLRAKL-NH2 | 910 |
| JBT1051 | 47 | | D | Ac-FQSKGNVFVDGYSERLRAKL-NH2 | 552 |
| JBT1052 | 84 | | C | Ac-FQSKGNVFVDGYFSRLRAKL-NH2 | 322 |
| JBT1053 | -7 | | | Ac-FQSKGNVFVDGYFESLRAKL-NH2 | 911 |
| JBT1054 | 1 | | | Ac-FQSKGNVFVDGYFERSRAKL-NH2 | 912 |
| JBT1055 | 78 | | D | Ac-FQSKGNVFVDGYFERLSAKL-NH2 | 553 |
| JBT1056 | 78 | | D | Ac-FQSKGNVFVDGYFERLRSKL-NH2 | 554 |
| JBT1057 | -9 | | | Ac-FQSKGNVFVDGYFERLRASL-NH2 | 913 |
| JBT1058 | 58 | | D | Ac-FQSKGNVFVDGYFERLRAKS-NH2 | 555 |
| JBT1059 | 69 | | D | Ac-TQSKGNVFVDGYFERLRAKL-NH2 | 556 |
| JBT1060 | -1 | | | Ac-FTSKGNVFVDGYFERLRAKL-NH2 | 914 |
| JBT1061 | 73 | | D | Ac-FQTKGNVFVDGYFERLRAKL-NH2 | 557 |
| JBT1062 | 51 | | D | Ac-FQSTGNVFVDGYFERLRAKL-NH2 | 558 |
| JBT1063 | 72 | | D | Ac-FQSKGTVFVDGYFERLRAKL-NH2 | 559 |
| JBT1064 | 49 | | D | Ac-FQSKGNTFVDGYFERLRAKL-NH2 | 560 |
| JBT1065 | -12 | | | Ac-FQSKGNVTVDGYFERLRAKL-NH2 | 915 |
| JBT1066 | 24 | | D | Ac-FQSKGNVFTDGYFERLRAKL-NH2 | 561 |

FIGURE 32Y

| Object ID | % Inhibition (relative to JBT-0477) | IC50 Mean (nM] | Affinity Class | Sequence | SEQ ID NO: |
|---|---|---|---|---|---|
| JBT1067 | -2 | | | Ac-FQSKGNVFVDTYFERLRAKL-NH2 | 916 |
| JBT1068 | -10 | | | Ac-FQSKGNVFVDGTFERLRAKL-NH2 | 917 |
| JBT1069 | 46 | | D | Ac-FQSKGNVFVDGYTERLRAKL-NH2 | 562 |
| JBT1070 | 97 | | A | Ac-FQSKGNVFVDGYFTRLRAKL-NH2 | 108 |
| JBT1071 | -9 | | | Ac-FQSKGNVFVDGYFETLRAKL-NH2 | 918 |
| JBT1072 | 9 | | | Ac-FQSKGNVFVDGYFERTRAKL-NH2 | 919 |
| JBT1073 | 82 | | C | Ac-FQSKGNVFVDGYFERLTAKL-NH2 | 323 |
| JBT1074 | 71 | | D | Ac-FQSKGNVFVDGYFERLRTKL-NH2 | 563 |
| JBT1075 | -15 | | | Ac-FQSKGNVFVDGYFERLRATL-NH2 | 920 |
| JBT1076 | 69 | | D | Ac-FQSKGNVFVDGYFERLRAKT-NH2 | 564 |
| JBT1077 | 81 | | C | Ac-VQSKGNVFVDGYFERLRAKL-NH2 | 324 |
| JBT1078 | -3 | | | Ac-FVSKGNVFVDGYFERLRAKL-NH2 | 921 |
| JBT1079 | 93 | | C | Ac-FQVKGNVFVDGYFERLRAKL-NH2 | 325 |
| JBT1080 | 92 | | C | Ac-FQSVGNVFVDGYFERLRAKL-NH2 | 326 |
| JBT1081 | 95 | | C | Ac-FQSKGVVFVDGYFERLRAKL-NH2 | 327 |
| JBT1082 | | 250 | D | Ac-FQSKaAVFVFGYFARLRAKL-NH2 | 565 |
| JBT1083 | 17 | | | Ac-FQSKGNVVVDGYFERLRAKL-NH2 | 922 |
| JBT1084 | | 45 | A | Ac-FQSK-Nmg-AVFVAGYFARLRAKL-NH2 | 109 |
| JBT1085 | -10 | | | Ac-FQSKGNVFVDVYFERLRAKL-NH2 | 923 |
| JBT1086 | -15 | | | Ac-FQSKGNVFVDGVFERLRAKL-NH2 | 924 |
| JBT1087 | 40 | | D | Ac-FQSKGNVFVDGYVERLRAKL-NH2 | 566 |
| JBT1088 | 99 | | A | Ac-FQSKGNVFVDGYFVRLRAKL-NH2 | 110 |
| JBT1089 | -4 | | | Ac-FQSKGNVFVDGYFEVLRAKL-NH2 | 925 |
| JBT1090 | 37 | | D | Ac-FQSKGNVFVDGYFERVRAKL-NH2 | 567 |
| JBT1091 | 91 | 53 | B | Ac-FQSKGNVFVDGYFERLVAKL-NH2 | 219 |

FIGURE 32Z

| Object ID | % Inhibition (relative to JBT-0477) | IC50 Mean (nM] | Affinity Class | Sequence | SEQ ID NO: |
|---|---|---|---|---|---|
| JBT1092 | 85 | | C | Ac-FQSKGNVFVDGYFERLRVKL-NH2 | 328 |
| JBT1093 | 6 | | | Ac-FQSKGNVFVDGYFERLRAVL-NH2 | 926 |
| JBT1094 | 68 | | D | Ac-FQSKGNVFVDGYFERLRAKV-NH2 | 568 |
| JBT1095 | 92 | | C | Ac-WQSKGNVFVDGYFERLRAKL-NH2 | 329 |
| JBT1096 | -3 | | | Ac-FWSKGNVFVDGYFERLRAKL-NH2 | 927 |
| JBT1097 | 55 | | D | Ac-FQWKGNVFVDGYFERLRAKL-NH2 | 569 |
| JBT1099 | 58 | | D | Ac-FQSKGWVFVDGYFERLRAKL-NH2 | 570 |
| JBT1100 | 45 | | D | Ac-FQSKGNWFVDGYFERLRAKL-NH2 | 571 |
| JBT1101 | 55 | | D | Ac-FQSKGNVWVDGYFERLRAKL-NH2 | 572 |
| JBT1102 | 4 | | D | Ac-FQSKGNVFWDGYFERLRAKL-NH2 | 573 |
| JBT1103 | 15 | | D | Ac-FQSKGNVFVDWYFERLRAKL-NH2 | 574 |
| JBT1104 | 0 | | | Ac-FQSKGNVFVDGWFERLRAKL-NH2 | 928 |
| JBT1105 | 85 | | C | Ac-FQSKGNVFVDGYWERLRAKL-NH2 | 330 |
| JBT1106 | 82 | 59 | B | Ac-FQSKGNVFVDGYFWRLRAKL-NH2 | 220 |
| JBT1107 | -7 | | | Ac-FQSKGNVFVDGYFEWLRAKL-NH2 | 929 |
| JBT1108 | 9 | | D | Ac-FQSKGNVFVDGYFERWRAKL-NH2 | 575 |
| JBT1109 | 78 | | D | Ac-FQSKGNVFVDGYFERLWAKL-NH2 | 576 |
| JBT1110 | 93 | | C | Ac-FQSKGNVFVDGYFERLRWKL-NH2 | 331 |
| JBT1111 | -6 | | | Ac-FQSKGNVFVDGYFERLRAWL-NH2 | 930 |
| JBT1112 | 87 | | C | Ac-FQSKGNVFVDGYFERLRAKW-NH2 | 332 |
| JBT1113 | 101 | | A | Ac-YQSKGNVFVDGYFERLRAKL-NH2 | 111 |
| JBT1114 | 12 | | | Ac-FYSKGNVFVDGYFERLRAKL-NH2 | 931 |
| JBT1115 | 75 | | D | Ac-FQYKGNVFVDGYFERLRAKL-NH2 | 577 |
| JBT1117 | 83 | | C | Ac-FQSKGYVFVDGYFERLRAKL-NH2 | 333 |
| JBT1118 | 82 | | C | Ac-FQSKGNYFVDGYFERLRAKL-NH2 | 334 |

FIGURE 32AA

| Object ID | % Inhibition (relative to JBT-0477) | IC50 Mean (nM] | Affinity Class | Sequence | SEQ ID NO: |
|---|---|---|---|---|---|
| JBT1119 | 99 | | A | Ac-FQSKGNVYVDGYFERLRAKL-NH2 | 112 |
| JBT1120 | 11 | | D | Ac-FQSKGNVFYDGYFERLRAKL-NH2 | 578 |
| JBT1121 | 12 | | | Ac-FQSKGNVFVDYYFERLRAKL-NH2 | 932 |
| JBT1122 | | 33 | A | Ac-FQSK-Nmg-NVFVDGYFARL-Nle-AKL-NH2 | 113 |
| JBT1123 | 84 | | C | Ac-FQSKGNVFVDGYYERLRAKL-NH2 | 335 |
| JBT1124 | 85 | | C | Ac-FQSKGNVFVDGYFYRLRAKL-NH2 | 336 |
| JBT1125 | 8 | | | Ac-FQSKGNVFVDGYFEYLRAKL-NH2 | 933 |
| JBT1126 | 11 | | | Ac-FQSKGNVFVDGYFERYRAKL-NH2 | 934 |
| JBT1127 | 92 | | C | Ac-FQSKGNVFVDGYFERLYAKL-NH2 | 337 |
| JBT1128 | 65 | | D | Ac-FQSKGNVFVDGYFERLRYKL-NH2 | 579 |
| JBT1129 | -7 | | | Ac-FQSKGNVFVDGYFERLRAYL-NH2 | 935 |
| JBT1130 | 76 | | D | Ac-FQSKGNVFVDGYFERLRAKY-NH2 | 580 |
| JBT1132 | | 20 | A | Fam-FQSKGNVFVDGYFERLRAKL-NH2 | 114 |
| JBT1133 | | 31 | A | Ac-FQSKkAVFVDGYFARLRAKL-NH2 | 115 |
| JBT1134 | | 39 | A | Ac-FQSKGAVFVDGYFARLRAKL-NH2 | 116 |
| JBT1135 | | 82 | B | Ac-FQSKDAVFVDGYFARLRAKL-NH2 | 221 |
| JBT1136 | | 40 | A | Ac-FQSKdAVFVDGYFARLRAKL-NH2 | 117 |
| JBT1137 | | 40 | A | Ac-FQSKkAVFVAGYFARLRAKL-NH2 | 118 |
| JBT1138 | | 64 | B | Ac-FQSKGAVFVAGYFARLRAKL-NH2 | 222 |
| JBT1139 | | 87 | B | Ac-FQSKDAVFVAGYFARLRAKL-NH2 | 223 |
| JBT1140 | | 36 | A | Ac-FQSKdAVFVAGYFARLRAKL-NH2 | 119 |
| JBT1141 | | 34 | A | Ac-FQSKkAVFVKGYFARLRAKL-NH2 | 120 |
| JBT1142 | | 53 | B | Ac-FQSKGAVFVKGYFARLRAKL-NH2 | 224 |
| JBT1143 | | 58 | B | Ac-FQSKDAVFVKGYFARLRAKL-NH2 | 225 |
| JBT1144 | | 34 | A | Ac-FQSKdAVFVKGYFARLRAKL-NH2 | 121 |

FIGURE 32AB

| Object ID | % Inhibition (relative to JBT-0477) | IC50 Mean (nM] | Affinity Class | Sequence | SEQ ID NO: |
|---|---|---|---|---|---|
| JBT1145 | | 45 | A | Ac-FQSKkAVFVTGYFARLRAKL-NH2 | 122 |
| JBT1146 | | 65 | B | Ac-FQSKGAVFVTGYFARLRAKL-NH2 | 226 |
| JBT1147 | | 95 | B | Ac-FQSKDAVFVTGYFARLRAKL-NH2 | 227 |
| JBT1148 | | 46 | A | Ac-FQSKdAVFVTGYFARLRAKL-NH2 | 123 |
| JBT1149 | | >5000 | | Ac-FQSKGNVFvFGYFERLRAKL-NH2 | 936 |
| JBT1150 | | 1154 | E | Ac-FQSKaNVFVTGYFERL-Nle-AKL-NH2 | 704 |
| JBT1151 | | >5000 | | Ac-FQSKKNVFVFGYFERLRAKD-NH2 | 937 |
| JBT1152 | | 4119 | F | Ac-FQSKKNVFFFGYFERLRAKL-NH2 | 735 |
| JBT1153 | | 1294 | E | Ac-FQSKKNVFVFGYFERLGAKL-NH2 | 705 |
| JBT1154 | | 27 | A | Fam-Ttds-FQSKGNVFVDGYFERLRAKL-NH2 | 124 |
| JBT1155 | | 31 | A | Ac-FQSK-Nmg-NVFVTGYFERLRAKL-NH2 | 125 |
| JBT1156 | | 41 | A | Ac-FQSKaNVFVDGYFARL-Nle-AKL-NH2 | 126 |
| JBT1157 | | 34 | A | Ac-FQSKaNVFVAGYFARLRAKL-NH2 | 127 |
| JBT1158 | | 51 | B | Ac-FQSKGNVFVFGYFERLRAKL-N-methyl | 228 |
| JBT1159 | | 38 | A | Ac-FQSKGNVFVFGYFERLRAKL-N-ethyl | 128 |
| JBT1161 | | 122 | C | Ac-FQSK-Aib-NVFVFGYFERLRAKL-NH2 | 338 |
| JBT1162 | | 28 | A | Ac-FQSKpNVFVFGYFERLRAKL-NH2 | 129 |
| JBT1164 | | 28 | A | Ac-FQSKGNVFVDGYFERLRAKLC-NH2 | 130 |
| JBT1166 | 70 | 129 | C | Ac-FQSKANVFVDGYFERLRAKL-NH2 | 339 |
| JBT1167 | 57 | | D | Ac-FQSKENVFVDGYFERLRAKL-NH2 | 581 |
| JBT1168 | 86 | 94 | B | Ac-FQSKFNVFVDGYFERLRAKL-NH2 | 229 |
| JBT1169 | 70 | 127 | C | Ac-FQSKHNVFVDGYFERLRAKL-NH2 | 340 |
| JBT1170 | 37 | | D | Ac-FQSKINVFVDGYFERLRAKL-NH2 | 582 |
| JBT1171 | 81 | | C | Ac-FQSKLNVFVDGYFERLRAKL-NH2 | 341 |
| JBT1173 | 11 | | D | Ac-FQSKPNVFVDGYFERLRAKL-NH2 | 583 |

FIGURE 32AC

| Object ID | % Inhibition (relative to JBT-0477) | IC50 Mean (nM] | Affinity Class | Sequence | SEQ ID NO: |
|---|---|---|---|---|---|
| JBT1174 | 83 | 115 | C | Ac-FQSKRNVFVDGYFERLRAKL-NH2 | 342 |
| JBT1175 | 63 | | D | Ac-FQSKSNVFVDGYFERLRAKL-NH2 | 584 |
| JBT1176 | 79 | | D | Ac-FQSKTNVFVDGYFERLRAKL-NH2 | 585 |
| JBT1177 | 61 | | D | Ac-FQSKVNVFVDGYFERLRAKL-NH2 | 586 |
| JBT1178 | 54 | | D | Ac-FQSKWNVFVDGYFERLRAKL-NH2 | 587 |
| JBT1179 | 86 | 100 | C | Ac-FQSKYNVFVDGYFERLRAKL-NH2 | 343 |
| JBT1180 | 101 | 98 | B | Ac-FQSKGNVFVAGYFERLRAKL-NH2 | 230 |
| JBT1181 | 86 | 107 | C | Ac-FQSKGNVFVGGYFERLRAKL-NH2 | 344 |
| JBT1182 | 71 | | D | Ac-FQSKGNVFVIGYFERLRAKL-NH2 | 588 |
| JBT1183 | 52 | | D | Ac-FQSKGNVFVLGYFERLRAKL-NH2 | 589 |
| JBT1184 | 97 | 52 | B | Ac-FQSKGNVFVMGYFERLRAKL-NH2 | 231 |
| JBT1185 | 105 | 50 | B | Ac-FQSKGNVFVPGYFERLRAKL-NH2 | 232 |
| JBT1186 | 60 | | D | Ac-FQSKGNVFVQGYFERLRAKL-NH2 | 590 |
| JBT1188 | 104 | | A | Ac-FQSKGNVFVSGYFERLRAKL-NH2 | 131 |
| JBT1189 | 124 | 48 | A | Ac-FQSKGNVFVVGYFERLRAKL-NH2 | 132 |
| JBT1190 | 116 | 101 | C | Ac-FQSKGNVFVWGYFERLRAKL-NH2 | 345 |
| JBT1191 | 112 | 158 | C | Ac-FQSKGNVFVYGYFERLRAKL-NH2 | 346 |
| JBT1192 | 81 | 113 | C | Ac-FQSKANVFVDGYFERLAAKL-NH2 | 347 |
| JBT1193 | 73 | | D | Ac-FQSKFNVFVDGYFERLAAKL-NH2 | 591 |
| JBT1194 | 65 | | D | Ac-FQSKYNVFVDGYHERLAAKL-NH2 | 592 |
| JBT1195 | 44 | | D | Ac-FQSSHNVFVDGYFERLAAKL-NH2 | 593 |
| JBT1196 | 85 | | C | Ac-FQSRENVFVDGYFERLAAKL-NH2 | 348 |
| JBT1197 | 100 | 63 | B | Ac-FQSKGNVFVDGYFMRLAAKL-NH2 | 233 |
| JBT1198 | 60 | | D | Ac-FQSAKNVFVDGYFERLRAKL-NH2 | 594 |
| JBT1199 | 62 | | D | Ac-FQSFKNVFVDGYFERLAAKL-NH2 | 595 |

FIGURE 32AD

| Object ID | % Inhibition (relative to JBT-0477) | IC50 Mean (nM] | Affinity Class | Sequence | SEQ ID NO: |
|---|---|---|---|---|---|
| JBT1200 | 53 | 226 | C | Ac-FQSKDNVFVHGYFERLAAKL-NH2 | 349 |
| JBT1201 | 44 | | D | Ac-FQDPKNVFVDGYFERLAAKL-NH2 | 596 |
| JBT1202 | 34 | | D | Ac-FQSKVNVFVDGYFERLAAKL-NH2 | 597 |
| JBT1203 | 50 | | D | Ac-FQSIKNVFVDGYFERLAAKL-NH2 | 598 |
| JBT1204 | 106 | 98 | B | Ac-YQSKNNVFVDGYFERLAAKL-NH2 | 234 |
| JBT1205 | 85 | 128 | C | Ac-FQSKERVFVDGYFERLAAKL-NH2 | 350 |
| JBT1206 | 104 | 74 | B | Ac-FQSKGHVFVDGYFERLAAKL-NH2 | 235 |
| JBT1207 | 48 | | D | Ac-FQSKTNIFVDGYFERLAAKL-NH2 | 599 |
| JBT1208 | 37 | | D | Ac-FQSHYNVFVDGYFERLAAKL-NH2 | 600 |
| JBT1209 | 32 | | D | Ac-FQSKENVFVDGYFDRLAAKL-NH2 | 601 |
| JBT1210 | 61 | 137 | C | Ac-FQSKQNVFVDGYFERLAIKL-NH2 | 351 |
| JBT1211 | 79 | 105 | C | Ac-FQSKYNVFVDGYFERLAVKL-NH2 | 352 |
| JBT1212 | 86 | | C | Ac-FQSRNNVFVDGYFERLAAKL-NH2 | 353 |
| JBT1213 | 64 | 122 | C | Ac-FQSRQNVFVDGYFERLAAKL-NH2 | 354 |
| JBT1214 | 64 | 132 | C | Ac-FQSKQNVFVDGYFERLAAKL-NH2 | 355 |
| JBT1215 | 72 | 171 | C | Ac-FQSSKNVFVDGYFERLAAKL-NH2 | 356 |
| JBT1216 | 70 | 117 | C | Ac-FQSKENVFVDGYFERLAAKL-NH2 | 357 |
| JBT1217 | 63 | | D | Ac-FQSHHNVFVDGYFERLAAKL-NH2 | 602 |
| JBT1218 | 72 | | D | Ac-FQSYKNVFVDGYFERLAAKL-NH2 | 603 |
| JBT1219 | 76 | 90 | B | Ac-FQSKKNVFVDGYFERLAAKL-NH2 | 236 |
| JBT1220 | 85 | 85 | B | Ac-FQTKHNVFVDGYFERLAAKL-NH2 | 237 |
| JBT1221 | 67 | | D | Ac-FQSKHNVFVDGYFERLAFKL-NH2 | 604 |
| JBT1222 | 85 | 82 | B | Ac-FQSKYNVFVDGYFERLAAKL-NH2 | 238 |
| JBT1223 | 54 | | D | Ac-FQSFKHVFVDGYFERLAAKL-NH2 | 605 |
| JBT1224 | 57 | | D | Ac-FQSKANVHVDGYFERLAAKL-NH2 | 606 |

FIGURE 32AE

| Object ID | % Inhibition (relative to JBT-0477) | IC50 Mean (nM] | Affinity Class | Sequence | SEQ ID NO: |
|---|---|---|---|---|---|
| JBT1225 | 77 | 107 | C | Ac-FQSKDNVFVDGYFERLAAKL-NH2 | 358 |
| JBT1226 | 26 | | | Ac-LQSKTNVFVDGYFERLAAKL-NH2 | 938 |
| JBT1227 | 99 | 76 | B | Ac-FQSKNNVFVDGYFERLAAKL-NH2 | 239 |
| JBT1228 | 99 | 55 | B | Ac-FQSKDHVFVDGYFERLAAKL-NH2 | 240 |
| JBT1229 | 93 | 92 | B | Ac-FQSKHNVFVDGYFERLARKL-NH2 | 241 |
| JBT1230 | 52 | | D | Ac-FQSKSNVFVDGYFERLAAKL-NH2 | 607 |
| JBT1231 | 68 | 92 | B | Ac-FQSKHNVFVDGYFERLAAKL-NH2 | 242 |
| JBT1232 | 47 | | D | Ac-FQSHKNVFVDGYFERLAAKL-NH2 | 608 |
| JBT1233 | 11 | | | Ac-FQSKFNVFVDGYTERLAAKL-NH2 | 939 |
| JBT1234 | 63 | | D | Ac-FQSKDNVFVDGYFERLAAKF-NH2 | 609 |
| JBT1235 | 65 | | D | Ac-FQSKMNVFVDGYFERLAAKL-NH2 | 610 |
| JBT1236 | 41 | | E | Ac-FQSVKNVFVDGYFERLAAKL-NH2 | 706 |
| JBT1238 | 14 | | | Ac-FQSKHNVFVDGHFERLAAKL-NH2 | 940 |
| JBT1240 | 61 | | D | Ac-FQSAYNVFVDGYFERLAAKL-NH2 | 611 |
| JBT1241 | 53 | | D | Ac-FQSKGNWFVDGYFERLAAKL-NH2 | 612 |
| JBT1242 | 49 | | E | Ac-FQSKVAVFVDGYFERLAAKL-NH2 | 707 |
| JBT1243 | 59 | | D | Ac-FQSAKNVFVDGYFVRLRAKL-NH2 | 613 |
| JBT1244 | 62 | | D | Ac-FQSKTNVFVDGYFERLAAKL-NH2 | 614 |
| JBT1245 | 34 | | F | Ac-FQSKKDVFVDGYFERLAAKL-NH2 | 736 |
| JBT1246 | 68 | | D | Ac-FQSKHVVFVDGYFERLAAKL-NH2 | 615 |
| JBT1247 | 39 | | F | Ac-FQSKSNVFVDGYFERLAARL-NH2 | 737 |
| JBT1248 | 6 | | | Ac-FQSVHNVFVDGYFERPAAKL-NH2 | 941 |
| JBT1249 | 7 | | | Ac-FQSKYNVFVDEYFERLAAKL-NH2 | 942 |
| JBT1250 | 66 | 216 | C | Ac-FQSKDNVFVDGYFERLAARL-NH2 | 359 |
| JBT1251 | 60 | | D | Ac-FQSKKHVFVDGYFERLAAKL-NH2 | 616 |

FIGURE 32AF

| Object ID | % Inhibition (relative to JBT-0477) | IC50 Mean (nM] | Affinity Class | Sequence | SEQ ID NO: |
|---|---|---|---|---|---|
| JBT1252 | 37 | | F | Ac-FQSTKNVFVDGYFERLAAKL-NH2 | 738 |
| JBT1253 | 30 | | D | Ac-FQSDKNVFVDGYFERLAAKL-NH2 | 617 |
| JBT1254 | 93 | 47 | A | Ac-FQSKHHVFVDGYFERLAAKL-NH2 | 133 |
| JBT1255 | 41 | | D | Ac-FQSNKNVFVDGYFERLAAKL-NH2 | 618 |
| JBT1256 | 88 | 125 | C | Ac-FQSKHNVYVDGYFERLAAKL-NH2 | 360 |
| JBT1257 | 40 | | D | Ac-FQSHKNVFVEGYFERLAAKL-NH2 | 619 |
| JBT1258 | 13 | | | Ac-FQSKPNVFVDGYFERLAAKL-NH2 | 943 |
| JBT1259 | 23 | | D | Ac-FQSYKDVFVDGYFERLATKL-NH2 | 620 |
| JBT1260 | 113 | 50 | A | Ac-FQSRRGVFVDGYFERLAAKL-NH2 | 134 |
| JBT1261 | 81 | 98 | B | Ac-FQSKLNVFVDGYFERLAAKL-NH2 | 243 |
| JBT1262 | 15 | | D | Ac-FQSKNNFFVDGYFERLAARL-NH2 | 621 |
| JBT1263 | 78 | 152 | C | Ac-FQSKYNIFVDGYFERLAAKL-NH2 | 361 |
| JBT1264 | 39 | | F | Ac-YQSKQNVFVDGYFERLAAKL-NH2 | 739 |
| JBT1265 | 58 | | D | Ac-FQSEQNVFVDGYFERLAAKL-NH2 | 622 |
| JBT1266 | 53 | | D | Ac-FQSEHNVFVDGYFERLAAKL-NH2 | 623 |
| JBT1267 | 55 | 219 | C | Ac-FQSKNDVFVDGYFERLAAKL-NH2 | 362 |
| JBT1268 | -8 | | | Ac-HQQFKNVFVDGYFERLAAKL-NH2 | 944 |
| JBT1269 | 58 | 155 | C | Ac-FQSGGNVFVDGYFERLAAKL-NH2 | 363 |
| JBT1270 | 61 | | D | Ac-FQSEKNVFVDGYFERLAAKL-NH2 | 624 |
| JBT1271 | 21 | | D | Ac-FQSKKNVFVDGYFERLAFKL-NH2 | 625 |
| JBT1272 | 58 | | D | Ac-FQSKRNVFVDGYFERLAAKL-NH2 | 626 |
| JBT1273 | 74 | 106 | C | Ac-FQSPKNVFVDGYFERLAAKL-NH2 | 364 |
| JBT1274 | 28 | | D | Ac-FQSGKNVFVDGYFERLAAKL-NH2 | 627 |
| JBT1275 | 68 | 123 | C | Ac-FQSPKNVFVDGYFERLRAKL-NH2 | 365 |
| JBT1277 | -4 | | | Ac-FQSKHNVFVDAYFERLRAKL-NH2 | 945 |

FIGURE 32AG

| Object ID | % Inhibition (relative to JBT-0477) | IC50 Mean (nM] | Affinity Class | Sequence | SEQ ID NO: |
|---|---|---|---|---|---|
| JBT1278 | 74 | 73 | B | Ac-FQSVGNVFVDGYFERLSAKL-NH2 | 244 |
| JBT1279 | 13 | | D | Ac-FQSYKNVFVDGYFERLFAKL-NH2 | 628 |
| JBT1280 | 56 | 160 | C | Ac-FQSRKNVFVDGYFERLRAKL-NH2 | 366 |
| JBT1281 | -5 | | | Ac-FQSKKNVFVDGYSERLRAKL-NH2 | 946 |
| JBT1282 | 52 | 176 | C | Ac-FQSKKRVFVDGYFERLRAKL-NH2 | 367 |
| JBT1283 | 36 | | F | Ac-FQSFENVFVDGYFERLHAKL-NH2 | 740 |
| JBT1285 | 100 | 186 | C | Ac-FQSIKNVFVDGYFERLRAKL-NH2 | 368 |
| JBT1286 | 113 | 69 | B | Ac-FQSYKNVFVDGYFERLRAKL-NH2 | 245 |
| JBT1287 | 86 | | C | Ac-CQSKGNVFVDGYFERLRAKL-NH2 | 369 |
| JBT1288 | 32 | | D | Ac-FCSKGNVFVDGYFERLRAKL-NH2 | 629 |
| JBT1289 | 96 | | A | Ac-FQCKGNVFVDGYFERLRAKL-NH2 | 135 |
| JBT1290 | 64 | | D | Ac-FQSCGNVFVDGYFERLRAKL-NH2 | 630 |
| JBT1292 | 109 | 30 | A | Ac-FQSKGCVFVDGYFERLRAKL-NH2 | 136 |
| JBT1293 | 17 | | D | Ac-FQSKGNCFVDGYFERLRAKL-NH2 | 631 |
| JBT1294 | -6 | | | Ac-FQSKGNVCVDGYFERLRAKL-NH2 | 947 |
| JBT1295 | 1 | | | Ac-FQSKGNVFCDGYFERLRAKL-NH2 | 948 |
| JBT1296 | 65 | | D | Ac-FQSKGNVFVCGYFERLRAKL-NH2 | 632 |
| JBT1297 | 66 | | D | Ac-FQSKGNVFVDCYFERLRAKL-NH2 | 633 |
| JBT1298 | -20 | | | Ac-FQSKGNVFVDGCFERLRAKL-NH2 | 949 |
| JBT1299 | 111 | 28 | A | Ac-FQSKGNVFVDGYCERLRAKL-NH2 | 137 |
| JBT1300 | 113 | | A | Ac-FQSKGNVFVDGYFCRLRAKL-NH2 | 138 |
| JBT1301 | -18 | | | Ac-FQSKGNVFVDGYFECLRAKL-NH2 | 950 |
| JBT1302 | 27 | | D | Ac-FQSKGNVFVDGYFERCRAKL-NH2 | 634 |
| JBT1303 | 97 | | A | Ac-FQSKGNVFVDGYFERLCAKL-NH2 | 139 |
| JBT1304 | 85 | | C | Ac-FQSKGNVFVDGYFERLRCKL-NH2 | 370 |

FIGURE 32AH

| Object ID | % Inhibition (relative to JBT-0477) | IC50 Mean (nM] | Affinity Class | Sequence | SEQ ID NO: |
|---|---|---|---|---|---|
| JBT1305 | -6 | | | Ac-FQSKGNVFVDGYFERLRACL-NH2 | 951 |
| JBT1306 | 65 | | D | Ac-FQSKGNVFVDGYFERLRAKC-NH2 | 635 |
| JBT1307 | 103 | | A | Ac-FQSKANVFVDGYFERLCAKL-NH2 | 140 |
| JBT1308 | 86 | | C | Ac-FQSKFNVFVDGYFERLCAKL-NH2 | 371 |
| JBT1309 | 92 | | C | Ac-FQSKYNVFVDGYHERLCAKL-NH2 | 372 |
| JBT1310 | 95 | | C | Ac-FQSSHNVFVDGYFERLCAKL-NH2 | 373 |
| JBT1311 | 83 | | C | Ac-FQSRENVFVDGYFERLCAKL-NH2 | 374 |
| JBT1312 | 99 | | A | Ac-FQSKGNVFVDGYFMRLCAKL-NH2 | 141 |
| JBT1313 | 87 | | C | Ac-FQSCKNVFVDGYFERLRAKL-NH2 | 375 |
| JBT1314 | 55 | | D | Ac-FQSFKNVFVDGYFERLCAKL-NH2 | 636 |
| JBT1315 | 95 | 35 | A | Ac-FQSKDNVFVHGYFERLCAKL-NH2 | 142 |
| JBT1316 | 90 | | C | Ac-FQDPKNVFVDGYFERLCAKL-NH2 | 376 |
| JBT1317 | 76 | | D | Ac-FQSKVNVFVDGYFERLCAKL-NH2 | 637 |
| JBT1318 | 73 | | D | Ac-FQSIKNVFVDGYFERLCAKL-NH2 | 638 |
| JBT1319 | 108 | 20 | A | Ac-YQSKNNVFVDGYFERLCAKL-NH2 | 143 |
| JBT1320 | 110 | 271 | D | Ac-FQSKERVFVDGYFERLCAKL-NH2 | 639 |
| JBT1321 | 117 | 31 | A | Ac-FQSKGHVFVDGYFERLCAKL-NH2 | 144 |
| JBT1322 | 89 | | C | Ac-FQSKTNIFVDGYFERLCAKL-NH2 | 377 |
| JBT1323 | 87 | 171 | C | Ac-FQSHYNVFVDGYFERLCAKL-NH2 | 378 |
| JBT1324 | 92 | 424 | D | Ac-FQSKENVFVDGYFDRLCAKL-NH2 | 640 |
| JBT1325 | 62 | | D | Ac-FQSKQNVFVDGYFERLCIKL-NH2 | 641 |
| JBT1326 | 61 | | D | Ac-FQSKYNVFVDGYFERLCVKL-NH2 | 642 |
| JBT1328 | 93 | | C | Ac-FQSRQNVFVDGYFERLCAKL-NH2 | 379 |
| JBT1329 | 96 | 20 | A | Ac-FQSKQNVFVDGYFERLCAKL-NH2 | 145 |
| JBT1330 | 86 | | C | Ac-FQSSKNVFVDGYFERLCAKL-NH2 | 380 |

FIGURE 32AI

| Object ID | % Inhibition (relative to JBT-0477) | IC50 Mean (nM] | Affinity Class | Sequence | SEQ ID NO: |
|---|---|---|---|---|---|
| JBT1331 | 100 | | A | Ac-FQSKENVFVDGYFERLCAKL-NH2 | 146 |
| JBT1332 | 87 | | C | Ac-FQSHHNVFVDGYFERLCAKL-NH2 | 381 |
| JBT1333 | 72 | | D | Ac-FQSYKNVFVDGYFERLCAKL-NH2 | 643 |
| JBT1334 | 103 | 23 | A | Ac-FQSKKNVFVDGYFERLCAKL-NH2 | 147 |
| JBT1335 | 111 | 247 | C | Ac-FQTKHNVFVDGYFERLCAKL-NH2 | 382 |
| JBT1336 | 61 | | D | Ac-FQSKHNVFVDGYFERLCFKL-NH2 | 644 |
| JBT1337 | 74 | | D | Ac-FQSKYNVFVDGYFERLCAKL-NH2 | 645 |
| JBT1338 | 46 | | D | Ac-FQSFKHVFVDGYFERLCAKL-NH2 | 646 |
| JBT1339 | 88 | | C | Ac-FQSKANVHVDGYFERLCAKL-NH2 | 383 |
| JBT1340 | 7 | | | Ac-FQSCKNVFVDGYFERLCAKL-NH2 | 952 |
| JBT1341 | 98 | 49 | A | Ac-FQSKDNVFVDGYFERLCAKL-NH2 | 148 |
| JBT1342 | 75 | | D | Ac-LQSKTNVFVDGYFERLCAKL-NH2 | 647 |
| JBT1343 | 99 | | A | Ac-FQSKNNVFVDGYFERLCAKL-NH2 | 149 |
| JBT1344 | 95 | | A | Ac-FQSKDHVFVDGYFERLCAKL-NH2 | 150 |
| JBT1345 | 91 | | C | Ac-FQSKHNVFVDGYFERLCRKL-NH2 | 384 |
| JBT1346 | 20 | | D | Ac-FQSKCNVFVDGYFERLCAKL-NH2 | 648 |
| JBT1347 | 95 | 24 | A | Ac-FQSKHNVFVDGYFERLCAKL-NH2 | 151 |
| JBT1348 | 91 | | C | Ac-FQSKSNVFVDGYFERLCAKL-NH2 | 385 |
| JBT1349 | 82 | | C | Ac-FQSHKNVFVDGYFERLCAKL-NH2 | 386 |
| JBT1350 | 35 | | D | Ac-FQSKFNVFVDGYTERLCAKL-NH2 | 649 |
| JBT1351 | 85 | | C | Ac-FQSKDNVFVDGYFERLCAKF-NH2 | 387 |
| JBT1352 | 85 | | C | Ac-FQSKMNVFVDGYFERLCAKL-NH2 | 388 |
| JBT1353 | 51 | | D | Ac-FQSVKNVFVDGYFERLCAKL-NH2 | 650 |
| JBT1354 | 86 | | C | Ac-FQSAKNVFVDGYFERLCAKL-NH2 | 389 |
| JBT1356 | 49 | | E | Ac-FQSKENVFVDGYFERLCYKL-NH2 | 708 |

FIGURE 32AJ

| Object ID | % Inhibition (relative to JBT-0477) | IC50 Mean (nM] | Affinity Class | Sequence | SEQ ID NO: |
|---|---|---|---|---|---|
| JBT1357 | 52 | | D | Ac-FQSKGNWFVDGYFERLCAKL-NH2 | 651 |
| JBT1358 | 20 | | D | Ac-FQSKVAVFVDGYFERLCAKL-NH2 | 652 |
| JBT1359 | 24 | | | Ac-FQSAYNVFVDGYFERLCAKL-NH2 | 953 |
| JBT1360 | 25 | | D | Ac-FQSCKNVFVDGYFVRLRAKL-NH2 | 653 |
| JBT1361 | 75 | | D | Ac-FQSKTNVFVDGYFERLCAKL-NH2 | 654 |
| JBT1362 | 76 | | D | Ac-FQSKKDVFVDGYFERLCAKL-NH2 | 655 |
| JBT1363 | 88 | | C | Ac-FQSKHVVFVDGYFERLCAKL-NH2 | 390 |
| JBT1364 | 64 | | D | Ac-FQSKSNVFVDGYFERLCARL-NH2 | 656 |
| JBT1365 | -4 | | | Ac-FQSVHNVFVDGYFERPCAKL-NH2 | 954 |
| JBT1366 | 21 | | | Ac-FQSKYNVFVDEYFERLCAKL-NH2 | 955 |
| JBT1367 | 83 | | C | Ac-FQSKDNVFVDGYFERLCARL-NH2 | 391 |
| JBT1368 | 89 | | C | Ac-FQSKKHVFVDGYFERLCAKL-NH2 | 392 |
| JBT1369 | 40 | | E | Ac-FQSTKNVFVDGYFERLCAKL-NH2 | 709 |
| JBT1370 | 52 | | D | Ac-FQSDKNVFVDGYFERLCAKL-NH2 | 657 |
| JBT1371 | 96 | | A | Ac-FQSKHHVFVDGYFERLCAKL-NH2 | 152 |
| JBT1372 | 83 | | C | Ac-FQSNKNVFVDGYFERLCAKL-NH2 | 393 |
| JBT1373 | 96 | | A | Ac-FQSKHNVYVDGYFERLCAKL-NH2 | 153 |
| JBT1374 | 71 | | D | Ac-FQSHKNVFVEGYFERLCAKL-NH2 | 658 |
| JBT1375 | 45 | | D | Ac-FQSKPNVFVDGYFERLCAKL-NH2 | 659 |
| JBT1376 | 47 | | D | Ac-FQSYKDVFVDGYFERLCTKL-NH2 | 660 |
| JBT1377 | 101 | | A | Ac-FQSRRGVFVDGYFERLCAKL-NH2 | 154 |
| JBT1378 | 70 | | D | Ac-FQSKLNVFVDGYFERLCAKL-NH2 | 661 |
| JBT1379 | 40 | | D | Ac-FQSKNNFFVDGYFERLCARL-NH2 | 662 |
| JBT1380 | 66 | | D | Ac-FQSKYNIFVDGYFERLCAKL-NH2 | 663 |
| JBT1381 | 106 | 19 | A | Ac-YQSKQNVFVDGYFERLCAKL-NH2 | 155 |

FIGURE 32AK

| Object ID | % Inhibition (relative to JBT-0477) | IC50 Mean (nM] | Affinity Class | Sequence | SEQ ID NO: |
|---|---|---|---|---|---|
| JBT1383 | 103 | | A | Ac-FQSEHNVFVDGYFERLCAKL-NH2 | 156 |
| JBT1384 | 105 | 23 | A | Ac-FQSKNDVFVDGYFERLCAKL-NH2 | 157 |
| JBT1385 | 54 | | D | Ac-HQQFKNVFVDGYFERLCAKL-NH2 | 664 |
| JBT1386 | 107 | 76 | B | Ac-FQSGGNVFVDGYFERLCAKL-NH2 | 246 |
| JBT1387 | 92 | | C | Ac-FQSEKNVFVDGYFERLCAKL-NH2 | 394 |
| JBT1388 | 90 | | C | Ac-FQSKKNVFVDGYFERLCFKL-NH2 | 395 |
| JBT1389 | 106 | 23 | A | Ac-FQSKRNVFVDGYFERLCAKL-NH2 | 158 |
| JBT1390 | 96 | | A | Ac-FQSPKNVFVDGYFERLCAKL-NH2 | 159 |
| JBT1391 | 99 | | A | Ac-FQSGKNVFVDGYFERLCAKL-NH2 | 160 |
| JBT1392 | 68 | 235 | C | Ac-FQSKQNVFVDGYFERLSAKL-NH2 | 396 |
| JBT1393 | 67 | 205 | C | Ac-FQSKKNVFVDGYFERLSAKL-NH2 | 397 |
| JBT1394 | 88 | 191 | C | Ac-FQSKDNVFVDGYFERLSAKL-NH2 | 398 |
| JBT1395 | 100 | 173 | C | Ac-FQSKHNVFVDGYFERLSAKL-NH2 | 399 |
| JBT1396 | | 29 | A | Ac-FQSK-Nmg-NVFVAGYFERLRAKL-NH2 | 161 |
| JBT1397 | 5 | 1569 | E | Ac-F-Aib-SKGNVFVDGYFERL-Aib-AKL-NH2 | 710 |
| JBT1398 | 5 | 660 | D | Ac-FQ-Aib-KGNVFVDGYFERL-Aib-AKL-NH2 | 665 |
| JBT1399 | 109 | 40 | A | Ac-FQS-Aib-GNVFVDGYFERL-Aib-AKL-NH2 | 162 |
| JBT1400 | 92 | 46 | A | Ac-FQSK-Aib-NVFVDGYFERL-Aib-AKL-NH2 | 163 |
| JBT1401 | -7 | 913 | D | Ac-FQSKG-Aib-VFVDGYFERL-Aib-AKL-NH2 | 666 |
| JBT1402 | -8 | 1144 | E | Ac-FQSKGN-Aib-FVDGYFERL-Aib-AKL-NH2 | 711 |
| JBT1403 | -6 | >5000 | | Ac-FQSKGNV-Aib-VDGYFERL-Aib-AKL-NH2 | 956 |
| JBT1404 | 13 | 329 | D | Ac-FQSKGNVF-Aib-DGYFERL-Aib-AKL-NH2 | 667 |
| JBT1405 | 6 | 313 | D | Ac-FQSKGNVFV-Aib-GYFERL-Aib-AKL-NH2 | 668 |
| JBT1406 | 3 | 610 | D | Ac-FQSKGNVFVD-Aib-YFERL-Aib-AKL-NH2 | 669 |
| JBT1407 | 6 | >5000 | | Ac-FQSKGNVFVDG-Aib- -Aib-AKL-NH2 | 957 |

FIGURE 32AL

| Object ID | % Inhibition (relative to JBT-0477) | IC50 Mean (nM) | Affinity Class | Sequence | SEQ ID NO: |
|---|---|---|---|---|---|
| JBT1408 | 78 | 92 | B | Ac-FQSKGNVFVDGY-Aib-ERL-Aib-AKL-NH2 | 247 |
| JBT1409 | 104 | 65 | B | Ac-FQSKGNVFVDGYF-Aib-RL-Aib-AKL-NH2 | 248 |
| JBT1410 | -3 | >5000 | | Ac-FQSKGNVFVDGYFE-Aib-L-Aib-AKL-NH2 | 958 |
| JBT1413 | -1 | >5000 | | Ac-FQSKGNVFVDGYFERL-Aib-A-Aib-L-NH2 | 959 |
| JBT1414 | 86 | 119 | C | Ac-FQSKGNVFVDGYFERL-Aib-AK-Aib-NH2 | 400 |
| JBT1415 | 5 | 3668 | F | Ac-Aib-QSKGNVFVDGYFERL-Aib-AKL-NH2 | 741 |
| JBT1584 | | 9 | A | Ac-FQSK-Nmg-NVFVDGYFERL-Aib-AKL-NH2 | 164 |
| JBT1585 | | 12 | A | Ac-FQSK-Nmg-NVFVTGYFERL-Aib-AKL-NH2 | 165 |
| JBT1586 | | 25 | A | AO-FQSKGNVFVDGYFERL-Aib-AKL-NH2 | 166 |
| JBT1587 | | 45 | A | Ac-FQSKGNVFVDGYFERL-Aib-AKLC-NH2 | 167 |
| JBT1590 | | 106 | C | Ac-FQSKGNVFV[CGYFERL-Aib-AKLC]-NH2 | 401 |
| JBT1591 | | 40 | A | Ac-FQSKGNVFVDGYF[CRL-Aib-AKLC]-NH2 | 168 |
| JBT1592 | | 105 | C | Ac-[CFQSKGNVFVDGYFERLC]AKL-NH2 | 402 |
| JBT1593 | | 462 | D | Ac-FQSK[CNVFVDGYFERLC]AKL-NH2 | 670 |
| JBT1594 | | 952 | D | Ac-FQSKGNVFV[CGYFERLC]AKL-NH2 | 671 |
| JBT1595 | | 249 | C | Ac-[CFQSKGNVFVC]GYFERL-Aib-AKL-NH2 | 403 |
| JBT1596 | | 129 | C | Ac-[CFQSKGC]VFVEGYFERL-Aib-AKL-NH2 | 404 |
| JBT1597 | | >5000 | | Ac-DGYFERLRAKL-NH2 | 960 |
| JBT1598 | | >5000 | | Ac-FQSKKNV-NH2 | 961 |
| JBT1843 | | 35 | A | Ac-FQSKGNIFVDGYFERLHAKL-NH2 | 169 |
| JBT1844 | | 41 | A | Ac-FQSKNNVFVDGYFKRLRAKL-NH2 | 170 |
| JBT1845 | | 89 | B | Ac-FQSYKHVFVDGYFERLRAKL-NH2 | 249 |
| JBT1846 | | 54 | B | Ac-FQSKGIVFVDGYFKRLRAKL-NH2 | 250 |
| JBT1847 | | 30 | A | Ac-YQTKGNVFVDGYFERLRAKL-NH2 | 171 |
| JBT1848 | | 112 | C | Ac-FQSKYNVFVDGYFERLFAKL-NH2 | 405 |

FIGURE 32AM

| Object ID | % Inhibition (relative to JBT-0477) | IC50 Mean (nM] | Affinity Class | Sequence | SEQ ID NO: |
|---|---|---|---|---|---|
| JBT1849 | | 44 | A | Ac-FQTKDNVHVDGYFERLRAKL-NH2 | 172 |
| JBT1850 | | 56 | B | Ac-FQSYKRVFVDGYFERLRAKL-NH2 | 251 |
| JBT1851 | | 49 | A | Ac-LQQKGNVFVDGYFERLRAKL-NH2 | 173 |
| JBT1852 | | 19 | A | PEG-FQSKGNVFVDGYFERL-Aib-AKL-NH2 | 174 |
| JBT1853 | | 42 | A | PEG-FQSKGNVFVDGYFERL-Aib-AKL-NH2 | 175 |
| JBT1854 | | 16 | A | Ac-FQSKGNVFVDGYFERL-Aib-AKLC(PEG)-NH2 | 176 |
| JBT1855 | | 96 | B | Ac-FQSKGNVFVDGYFERL-Aib-AKLC(PEG)-NH2 | 252 |
| JBT1856 | | 17 | A | Ac-FQSKpNVFVDGYFERL-Aib-AKL-NH2 | 177 |
| JBT1857 | | 14 | A | Ac-FQSKpNVHVDGYFERL-Aib-AKL-NH2 | 178 |
| JBT2266 | | 20 | A | Ac-PFQSKGNVFVDGYFERLRAKL-NH2 | 179 |
| JBT2267 | | 19 | A | Ac-PEFQSKGNVFVDGYFERLRAKL-NH2 | 180 |
| JBT2268 | | 18 | A | Ac-PFQSK-Nme-NVFVDGYFERL-Aib-AKL-NH2 | 181 |

FIGURE 33

| Object ID | EC50 (nM] | Sequence | SEQ ID NO: |
|---|---|---|---|
| JBT0051 | 1.0 | Biotinyl-Ttds-SGVGRLQVAFQSKKNVFVFGYFERLRAKLTS-NH2 | 962 |
| JBT0055 | 1.7 | Ac-SGVGRLQVAFQSKKNVFVFGYFERLRAKLTS-Ttds-Lysin(biotin)-NH2 | 963 |
| JBT0131 | 16.8 | Biotinyl-Ttds-AFQSKKNVFVFGYFERLRAK-NH2 | 964 |
| JBT0132 | 2.2 | Biotinyl-Ttds-FQSKKNVFVFGYFERLRAKL-NH2 | 965 |
| JBT0133 | >25000 | Biotinyl-Ttds-Ttds-QSKKNVFVFGYFERLRAKLT-NH2 | 966 |
| JBT0134 | >1000 | Biotinyl-Ttds-QSKKNVFVFGYFERLRAK-NH2 | 967 |
| JBT0166 | 0.9 | Biotinyl-Ttds-KKFQSKKNVFVFGYFERLRAKLKK-NH2 | 968 |
| JBT0167* | 574.8 | Biotinyl-Ttds-GKNAKFYLFESLRQVKFVFR-NH2 | 969 |
| JBT0168* | 152.3 | Biotinyl-Ttds-YKFSFNKELFKQARLRFVGV-NH2 | 970 |
| JBT0173 | >5000 | Biotinyl-Ttds-SGVGRLQVAFQSKKNVFVFG-NH2 | 971 |
| JBT0403 | 1.4 | Biotinyl-Ttds-FQSKKNVFVDGYFERLRAKL-NH2 | 972 |

FIGURE 34A

| Object ID | IC50 [nm] | Affinity Class | Sequence | SEQ ID NO: |
|---|---|---|---|---|
| JBT0120 | 59 | B | Ac-SGASRYKWF[CGMRDMKGTMSC]VWVKFRYDTS-NH2 | 1047 |
| JBT0247 | >206 | | Ac-SGASRYKWFCGMRDMKGTMSCVWVKFRYDTS-NH2 | 1213 |
| JBT0248 | 30 | A | Ac-KKSGASRYKWF[CGMRDMKGTMSC]VWVKFRYDTSKK-NH2 | 1001 |
| JBT0249 | >50000 | | Ac-KKSGASRYKWFCGMRDMKGTMSKK-NH2 | 1214 |
| JBT0250 | 8766 | F | Ac-KKSRYKWFCGMRDMKGTMSCVWKK-NH2 | 1201 |
| JBT0251 | 5207 | F | Ac-KKKWFCGMRDMKGTMSCVWVKFKK-NH2 | 1202 |
| JBT0252 | >50000 | | Ac-KKCGMRDMKGTMSCVWVKFRYDKK-NH2 | 1215 |
| JBT0253 | >207 | | Ac-KKMRDMKGTMSCVWVKFRYDTSKK-NH2 | 1216 |
| JBT0319 | 32 | A | Ac-SGASRYKWF[CGMRDMKGTMSC]VWVKFRY-NH2 | 1002 |
| JBT0319 | 109 | C | Ac-SGASRYKWF[CGMRDMKGTMSC]VWVKFRY-NH2 | 1075 |
| JBT0320 | 977 | D | Ac-SGASRYKWF[CGMRDMKGTMSC]VWVK-NH2 | 1103 |
| JBT0321 | >50000 | | Ac-SGASRYKWF[CGMRDMKGTMSC]V-NH2 | 1217 |
| JBT0322 | >50000 | | Ac-SGASRYKWFCGMRDMKGTM-NH2 | 1218 |
| JBT0323 | 118 | C | Ac-SRYKWF[CGMRDMKGTMSC]VWVKFRYDTS-NH2 | 1076 |
| JBT0324 | 1931 | E | Ac-KWF[CGMRDMKGTMSC]VWVKFRYDTS-NH2 | 1155 |
| JBT0325 | >50000 | | Ac-[CGMRDMKGTMSC]VWVKFRYDTS-NH2 | 1219 |
| JBT0326 | >10000 | | Ac-RDMKGTMSCVWVKFRYDTS-NH2 | 1220 |
| JBT0326 | >50000 | | Ac-RDMKGTMSCVWVKFRYDTS-NH2 | 1221 |
| JBT0327 | >50000 | | Ac-SGASRYKWFCGMRDMKGTMS-NH2 | 1222 |
| JBT0328 | >50000 | | Ac-SRYKWF[CGMRDMKGTMSC]VW-NH2 | 1223 |
| JBT0329 | 4574 | E | Ac-KWF[CGMRDMKGTMSC]VWVKF-NH2 | 1156 |
| JBT0329 | 9396 | F | Ac-KWF[CGMRDMKGTMSC]VWVKF-NH2 | 1203 |
| JBT0330 | >50000 | | Ac-[CGMRDMKGTMSC]VWVKFRYD-NH2 | 1224 |
| JBT0331 | >10001 | | Ac-MRDMKGTMSCVWVKFRYDTS-NH2 | 1225 |
| JBT0331 | >50000 | | Ac-MRDMKGTMSCVWVKFRYDTS-NH2 | 1226 |
| JBT0332 | 29746 | G | Ac-SRYKWFCGMRDMKGTMSCVW-NH2 | 1206 |
| JBT0333 | 18840 | G | Ac-KWFCGMRDMKGTMSCVWVKF-NH2 | 1207 |
| JBT0334 | >10002 | | Ac-CGMRDMKGTMSCVWVKFRYD-NH2 | 1227 |
| JBT0409 | 6413 | F | Ac-SGASRYKWFSGMRDMKGTMSSVWVKFRYDTS-NH2 | 1204 |

FIGURE 34B

| Object ID | IC50 [nm] | Affinity Class | Sequence | SEQ ID NO: |
|---|---|---|---|---|
| JBT0410 | 24801 | G | Ac-SGASRYKWFSG-Nle-RD-Nle-KGT-Nle-SSVWVKFRYDTS-NH2 | 1208 |
| JBT0411 | 685 | D | Ac-SGASRYKWF[CG-Nle-RD-Nle-KGT-Nle-SC]VWVKFRYDTS-NH2 | 1104 |
| JBT0412 | 16103 | G | Ac-KWF[CG-Nle-RD-Nle-KGT-Nle-SC]VWVKF-NH2 | 1209 |
| JBT0413 | >50000 | | Ac-KWFSGMRDMKGTMSSVWVKF-NH2 | 1228 |
| JBT0414 | 5693 | F | Ac-KWFSG-Nle-RD-Nle-KGT-Nle-SSVWVKF-NH2 | 1205 |
| JBT0415 | 50 | A | Ac-SRYKWF[CGMRDMKGTMSC]VWVKF-NH2 | 1003 |
| JBT0416 | 187 | C | Ac-SRYKWF[CG-Nle-RD-Nle-KGT-Nle-SC]VWVKF-NH2 | 1077 |
| JBT0417 | >50000 | | Ac-SRYKWFSGMRDMKGTMSSVWVKF-NH2 | 1229 |
| JBT0418 | 43941 | G | Ac-SRYKWF SG-Nle-RD-Nle-KGT-Nle-SS VWVKF-NH2 | 1210 |
| JBT0435* | 31732 | G | Ac-RKRDVSGKM[CWSGFGSKWFRC]ADMMTYYSVT-NH2 | 1211 |
| JBT0436* | 45925 | G | Ac-RWSGKSTYS[CDAMVRRMGMKC]FSFGWTDVYK-NH2 | 1212 |
| JBT0437 | 60 | B | Ac-ARYKWF[CGMRDMKGTMSC]VWVKF-NH2 | 1048 |
| JBT0438 | 194 | C | Ac-SAYKWF[CGMRDMKGTMSC]VWVKF-NH2 | 1078 |
| JBT0439 | 291 | D | Ac-SRAKWF[CGMRDMKGTMSC]VWVKF-NH2 | 1105 |
| JBT0440 | 393 | D | Ac-SRYAWF[CGMRDMKGTMSC]VWVKF-NH2 | 1106 |
| JBT0441 | >5000 | | Ac-SRYKAF[CGMRDMKGTMSC]VWVKF-NH2 | 1230 |
| JBT0442 | >5000 | | Ac-SRYKWA[CGMRDMKGTMSC]VWVKF-NH2 | 1231 |
| JBT0443 | 2861 | E | Ac-SRYKWF AGMRDMKGTMSC VWVKF-NH2 | 1157 |
| JBT0444 | 18 | A | Ac-SRYKWF[CAMRDMKGTMSC]VWVKF-NH2 | 1004 |
| JBT0444 | 31 | A | Ac-SRYKWF[CAMRDMKGTMSC]VWVKF-NH2 | 1005 |
| JBT0445 | 760 | D | Ac-SRYKWF[CGARDMKGTMSC]VWVKF-NH2 | 1107 |
| JBT0446 | 152 | C | Ac-SRYKWF[CGMADMKGTMSC]VWVKF-NH2 | 1079 |
| JBT0447 | 3249 | E | Ac-SRYKWF[CGMRAMKGTMSC]VWVKF-NH2 | 1158 |
| JBT0448 | 315 | D | Ac-SRYKWF[CGMRDAKGTMSC]VWVKF-NH2 | 1108 |
| JBT0449 | 104 | C | Ac-SRYKWF[CGMRDMAGTMSC]VWVKF-NH2 | 1080 |
| JBT0450 | 1061 | E | Ac-SRYKWF[CGMRDMKATMSC]VWVKF-NH2 | 1159 |
| JBT0451 | 131 | C | Ac-SRYKWF[CGMRDMKGAMSC]VWVKF-NH2 | 1081 |
| JBT0452 | 313 | D | Ac-SRYKWF[CGMRDMKGTASC]VWVKF-NH2 | 1109 |
| JBT0453 | 343 | D | Ac-SRYKWF[CGMRDMKGTMAC]VWVKF-NH2 | 1110 |
| JBT0454 | 4963 | E | Ac-SRYKWF CGMRDMKGTMSA VWVKF-NH2 | 1160 |
| JBT0455 | 99 | B | Ac-SRYKWF[CGMRDMKGTMSC]AWVKF-NH2 | 1049 |
| JBT0456 | >5000 | | Ac-SRYKWF[CGMRDMKGTMSC]VAVKF-NH2 | 1232 |

FIGURE 34C

| Object ID | IC50 [nm] | Affinity Class | Sequence | SEQ ID NO: |
|---|---|---|---|---|
| JBT0457 | 2896 | E | Ac-SRYKWF[CGMRDMKGTMSC]VWAKF-NH2 | 1161 |
| JBT0458 | 148 | C | Ac-SRYKWF[CGMRDMKGTMSC]VWVAF-NH2 | 1082 |
| JBT0459 | 150 | C | Ac-SRYKWF[CGMRDMKGTMSC]VWVKA-NH2 | 1083 |
| JBT0460 | 88 | B | Ac-RYKWF[CGMRDMKGTMSC]VWVKF-NH2 | 1050 |
| JBT0461 | 503 | D | Ac-YKWF[CGMRDMKGTMSC]VWVKF-NH2 | 1111 |
| JBT0462 | >5000 | | Ac-SRYKWFGM[CRDMKGTMSC]VWVKF-NH2 | 1233 |
| JBT0463 | >5000 | | Ac-SRYKWFGMRD[CMKGTMSC]VWVKF-NH2 | 1234 |
| JBT0464 | >5000 | | Ac-SRYKWFGMRDMK[CGTMSC]VWVKF-NH2 | 1235 |
| JBT0465 | >5000 | | Ac-SRYKWF[CGMRDMKGTC]MSVWVKF-NH2 | 1236 |
| JBT0466 | >5000 | | Ac-SRYKWF[CGMRDMKC]GTMSVWVKF-NH2 | 1237 |
| JBT0467 | >5000 | | Ac-SRYKWF[CGMRDC]MKGTMSVWVKF-NH2 | 1238 |
| JBT0468 | >5000 | | Ac-SRYKWFG[CMRDMKGTMC]SVWVKF-NH2 | 1239 |
| JBT0469 | >5000 | | Ac-SRYKWFGM[CRDMKGTC]MSVWVKF-NH2 | 1240 |
| JBT0470 | 1472 | E | Ac-SRYKWFGMR[CDMKGC]TMSVWVKF-NH2 | 1162 |
| JBT0617 | 489 | D | Ac-SRYKWF[homoC-GMRDMKGTMSC]VWVKF-NH2 | 1112 |
| JBT0618 | 2073 | E | Ac-SRYKWF[CGMRDMKGTMS-homoC]VWVKF-NH2 | 1163 |
| JBT0619 | >5000 | | Ac-SRYKWF[homoC-GMRDMKGTMS-homoC]VWVKF-NH2 | 1241 |
| JBT0620 | >5000 | | Ac-SRYKWF[Dap-GMRDMKGTMS-D]VWVKF-NH2 | 1242 |
| JBT0623 | >5000 | | Ac-SRYKWF[K-GMRDMKGTMS-D]VWVKF-NH2 | 1243 |
| JBT0625 | >5000 | | Ac-SRYKWF[CMRDMKGTMSC]VWVKF-NH2 | 1244 |
| JBT0626 | 1078 | E | Ac-SRYKWF[CGMRDKGTMSC]VWVKF-NH2 | 1164 |
| JBT0627 | 2169 | E | Ac-SRYKWF[CGMRDMGTMSC]VWVKF-NH2 | 1165 |
| JBT0628 | 3611 | E | Ac-SRYKWF[CGMRDMKGMSC]VWVKF-NH2 | 1166 |
| JBT0629 | 4076 | E | Ac-SRYKWF[cGMRDMKGTMSC]VWVKF-NH2 | 1167 |
| JBT0631 | 343 | D | Ac-SRYKWF[CGmRDMKGTMSC]VWVKF-NH2 | 1113 |
| JBT0632 | >5000 | | Ac-SRYKWF[CGMrDMKGTMSC]VWVKF-NH2 | 1245 |
| JBT0633 | 2131 | E | Ac-SRYKWF[CGMRdMKGTMSC]VWVKF-NH2 | 1168 |
| JBT0634 | 61 | B | Ac-SRYKWF[CGMRDmKGTMSC]VWVKF-NH2 | 1051 |
| JBT0635 | 433 | D | Ac-SRYKWF[CGMRDMkGTMSC]VWVKF-NH2 | 1114 |
| JBT0637 | 3590 | E | Ac-SRYKWF[CGMRDMKGtMSC]VWVKF-NH2 | 1169 |
| JBT0638 | >5000 | | Ac-SRYKWF[CGMRDMKGTmSC]VWVKF-NH2 | 1246 |
| JBT0639 | 1220 | E | Ac-SRYKWF[CGMRDMKGTMsC]VWVKF-NH2 | 1170 |

FIGURE 34D

| Object ID | IC50 [nm] | Affinity Class | Sequence | SEQ ID NO: |
|---|---|---|---|---|
| JBT0640 | 3470 | E | Ac-SRYKWF[CGMRDMKGTMSc]VWVKF-NH2 | 1171 |
| JBT0641 | >5000 | | Ac-SRYKWF[CPMRDMKGTMSC]VWVKF-NH2 | 1247 |
| JBT0642 | >5000 | | Ac-SRYKWF[CGPRDMKGTMSC]VWVKF-NH2 | 1248 |
| JBT0643 | 23 | A | Ac-SRYKWF[CGMPDMKGTMSC]VWVKF-NH2 | 1006 |
| JBT0644 | 2873 | E | Ac-SRYKWF[CGMRPMKGTMSC]VWVKF-NH2 | 1172 |
| JBT0645 | 165 | C | Ac-SRYKWF[CGMRDPKGTMSC]VWVKF-NH2 | 1084 |
| JBT0646 | 3169 | E | Ac-SRYKWF[CGMRDMPGTMSC]VWVKF-NH2 | 1173 |
| JBT0647 | >5000 | | Ac-SRYKWF[CGMRDMKPTMSC]VWVKF-NH2 | 1249 |
| JBT0648 | 3682 | E | Ac-SRYKWF[CGMRDMKGPMSC]VWVKF-NH2 | 1174 |
| JBT0649 | 2989 | E | Ac-SRYKWF[CGMRDMKGTPSC]VWVKF-NH2 | 1175 |
| JBT0650 | >5000 | | Ac-SRYKWF[CGMRDMKGTMPC]VWVKF-NH2 | 1250 |
| JBT0790 | 255 | D | H-GSSRYKWF[CGMRDMKGTMSC]VWVKF-OH | 1115 |
| JBT1416 | 39 | A | Ac-DRYKWF[CGMRDMKGTMSC]VWVKF-NH2 | 1007 |
| JBT1417 | 344 | D | Ac-SDYKWF[CGMRDMKGTMSC]VWVKF-NH2 | 1116 |
| JBT1418 | 1469 | E | Ac-SRDKWF[CGMRDMKGTMSC]VWVKF-NH2 | 1176 |
| JBT1419 | 536 | D | Ac-SRYDWF[CGMRDMKGTMSC]VWVKF-NH2 | 1117 |
| JBT1420 | >5000 | | Ac-SRYKDF[CGMRDMKGTMSC]VWVKF-NH2 | 1251 |
| JBT1421 | >5000 | | Ac-SRYKWD[CGMRDMKGTMSC]VWVKF-NH2 | 1252 |
| JBT1422 | >5000 | | Ac-SRYKWF[CDMRDMKGTMSC]VWVKF-NH2 | 1253 |
| JBT1423 | 4671 | E | Ac-SRYKWF[CGDRDMKGTMSC]VWVKF-NH2 | 1177 |
| JBT1424 | >5000 | | Ac-SRYKWF[CGMDDMKGTMSC]VWVKF-NH2 | 1254 |
| JBT1425 | 101 | C | Ac-SRYKWF[CGMRDDKGTMSC]VWVKF-NH2 | 1085 |
| JBT1426 | 17 | A | Ac-SRYKWF[CGMRDMDGTMSC]VWVKF-NH2 | 1008 |
| JBT1427 | 87 | B | Ac-SRYKWF[CGMRDMKDTMSC]VWVKF-NH2 | 1052 |
| JBT1428 | 478 | D | Ac-SRYKWF[CGMRDMKGDMSC]VWVKF-NH2 | 1118 |
| JBT1429 | 107 | C | Ac-SRYKWF[CGMRDMKGTDSC]VWVKF-NH2 | 1086 |
| JBT1430 | 265 | D | Ac-SRYKWF[CGMRDMKGTMDC]VWVKF-NH2 | 1119 |
| JBT1431 | >5000 | | Ac-SRYKWF[CGMRDMKGTMSC]DWVKF-NH2 | 1255 |
| JBT1432 | >5000 | | Ac-SRYKWF[CGMRDMKGTMSC]VDVKF-NH2 | 1256 |
| JBT1433 | >5000 | | Ac-SRYKWF[CGMRDMKGTMSC]VWDKF-NH2 | 1257 |
| JBT1434 | 515 | D | Ac-SRYKWF[CGMRDMKGTMSC]VWVDF-NH2 | 1120 |
| JBT1435 | 34 | A | Ac-SRYKWF[CGMRDMKGTMSC]VWVKD-NH2 | 1009 |

FIGURE 34E

| Object ID | IC50 [nm] | Affinity Class | Sequence | SEQ ID NO: |
|---|---|---|---|---|
| JBT1436 | 54 | B | Ac-FRYKWF[CGMRDMKGTMSC]VWVKF-NH2 | 1053 |
| JBT1437 | 33 | A | Ac-SFYKWF[CGMRDMKGTMSC]VWVKF-NH2 | 1010 |
| JBT1438 | 40 | A | Ac-SRFKWF[CGMRDMKGTMSC]VWVKF-NH2 | 1011 |
| JBT1439 | 572 | D | Ac-SRYFWF[CGMRDMKGTMSC]VWVKF-NH2 | 1121 |
| JBT1440 | >5000 | | Ac-SRYKFF[CGMRDMKGTMSC]VWVKF-NH2 | 1258 |
| JBT1441 | >5000 | | Ac-SRYKWF[CFMRDMKGTMSC]VWVKF-NH2 | 1259 |
| JBT1442 | 2701 | E | Ac-SRYKWF[CGFRDMKGTMSC]VWVKF-NH2 | 1178 |
| JBT1443 | 1218 | E | Ac-SRYKWF[CGMFDMKGTMSC]VWVKF-NH2 | 1179 |
| JBT1444 | >5000 | | Ac-SRYKWF[CGMRFMKGTMSC]VWVKF-NH2 | 1260 |
| JBT1445 | 43 | A | Ac-SRYKWF[CGMRDFKGTMSC]VWVKF-NH2 | 1012 |
| JBT1446 | 69 | B | Ac-SRYKWF[CGMRDMFGTMSC]VWVKF-NH2 | 1054 |
| JBT1447 | 344 | D | Ac-SRYKWF[CGMRDMKFTMSC]VWVKF-NH2 | 1122 |
| JBT1448 | 296 | D | Ac-SRYKWF[CGMRDMKGFMSC]VWVKF-NH2 | 1123 |
| JBT1449 | 23 | A | Ac-SRYKWF[CGMRDMKGTFSC]VWVKF-NH2 | 1013 |
| JBT1450 | 475 | D | Ac-SRYKWF[CGMRDMKGTMFC]VWVKF-NH2 | 1124 |
| JBT1451 | 236 | C | Ac-SRYKWF[CGMRDMKGTMSC]FWVKF-NH2 | 1087 |
| JBT1452 | 546 | D | Ac-SRYKWF[CGMRDMKGTMSC]VFVKF-NH2 | 1125 |
| JBT1453 | >5000 | | Ac-SRYKWF[CGMRDMKGTMSC]VWFKF-NH2 | 1261 |
| JBT1454 | >5000 | | Ac-SRYKWF[CGMRDMKGTMSC]VWVFF-NH2 | 1262 |
| JBT1455 | 39 | A | Ac-GRYKWF[CGMRDMKGTMSC]VWVKF-NH2 | 1014 |
| JBT1456 | 265 | D | Ac-SGYKWF[CGMRDMKGTMSC]VWVKF-NH2 | 1126 |
| JBT1457 | 1866 | E | Ac-SRGKWF[CGMRDMKGTMSC]VWVKF-NH2 | 1180 |
| JBT1458 | 430 | D | Ac-SRYGWF[CGMRDMKGTMSC]VWVKF-NH2 | 1127 |
| JBT1459 | >5000 | | Ac-SRYKGF[CGMRDMKGTMSC]VWVKF-NH2 | 1263 |
| JBT1460 | >5000 | | Ac-SRYKWG[CGMRDMKGTMSC]VWVKF-NH2 | 1264 |
| JBT1461 | 2099 | E | Ac-SRYKWF[CGGRDMKGTMSC]VWVKF-NH2 | 1181 |
| JBT1462 | 370 | D | Ac-SRYKWF[CGMGDMKGTMSC]VWVKF-NH2 | 1128 |
| JBT1463 | 682 | D | Ac-SRYKWF[CGMRGMKGTMSC]VWVKF-NH2 | 1129 |
| JBT1464 | 150 | C | Ac-SRYKWF[CGMRDGKGTMSC]VWVKF-NH2 | 1088 |
| JBT1465 | 50 | A | Ac-SRYKWF[CGMRDMGGTMSC]VWVKF-NH2 | 1015 |
| JBT1466 | 85 | B | Ac-SRYKWF[CGMRDMKGGMSC]VWVKF-NH2 | 1055 |
| JBT1467 | 290 | D | Ac-SRYKWF[CGMRDMKGTGSC]VWVKF-NH2 | 1130 |

FIGURE 34F

| Object ID | IC50 [nm] | Affinity Class | Sequence | SEQ ID NO: |
|---|---|---|---|---|
| JBT1468 | 778 | D | Ac-SRYKWF[CGMRDMKGTMGC]VWVKF-NH2 | 1131 |
| JBT1469 | 2366 | E | Ac-SRYKWF[CGMRDMKGTMSC]GWVKF-NH2 | 1182 |
| JBT1470 | >5000 | | Ac-SRYKWF[CGMRDMKGTMSC]VGVKF-NH2 | 1265 |
| JBT1471 | >5000 | | Ac-SRYKWF[CGMRDMKGTMSC]VWGKF-NH2 | 1266 |
| JBT1472 | 158 | C | Ac-SRYKWF[CGMRDMKGTMSC]VWVGF-NH2 | 1089 |
| JBT1473 | 176 | C | Ac-SRYKWF[CGMRDMKGTMSC]VWVKG-NH2 | 1090 |
| JBT1474 | 31 | A | Ac-KRYKWF[CGMRDMKGTMSC]VWVKF-NH2 | 1016 |
| JBT1475 | 69 | B | Ac-SKYKWF[CGMRDMKGTMSC]VWVKF-NH2 | 1056 |
| JBT1476 | 282 | D | Ac-SRKKWF[CGMRDMKGTMSC]VWVKF-NH2 | 1132 |
| JBT1477 | >5000 | | Ac-SRYKKF[CGMRDMKGTMSC]VWVKF-NH2 | 1267 |
| JBT1478 | 162 | C | Ac-SRYKWK[CGMRDMKGTMSC]VWVKF-NH2 | 1091 |
| JBT1479 | 1110 | E | Ac-SRYKWF[CKMRDMKGTMSC]VWVKF-NH2 | 1183 |
| JBT1480 | 392 | D | Ac-SRYKWF[CGKRDMKGTMSC]VWVKF-NH2 | 1133 |
| JBT1481 | 20 | A | Ac-SRYKWF[CGMKDMKGTMSC]VWVKF-NH2 | 1017 |
| JBT1482 | 1354 | E | Ac-SRYKWF[CGMRKMKGTMSC]VWVKF-NH2 | 1184 |
| JBT1483 | 59 | B | Ac-SRYKWF[CGMRDKKGTMSC]VWVKF-NH2 | 1057 |
| JBT1484 | 520 | D | Ac-SRYKWF[CGMRDMKKTMSC]VWVKF-NH2 | 1134 |
| JBT1485 | 67 | B | Ac-SRYKWF[CGMRDMKGKMSC]VWVKF-NH2 | 1058 |
| JBT1486 | 54 | B | Ac-SRYKWF[CGMRDMKGTKSC]VWVKF-NH2 | 1059 |
| JBT1487 | 434 | D | Ac-SRYKWF[CGMRDMKGTMKC]VWVKF-NH2 | 1135 |
| JBT1488 | >5000 | | Ac-SRYKWF[CGMRDMKGTMSC]KWVKF-NH2 | 1268 |
| JBT1489 | >5000 | | Ac-SRYKWF[CGMRDMKGTMSC]VKVKF-NH2 | 1269 |
| JBT1490 | >5000 | | Ac-SRYKWF[CGMRDMKGTMSC]VWKKF-NH2 | 1270 |
| JBT1491 | 335 | D | Ac-SRYKWF[CGMRDMKGTMSC]VWVKK-NH2 | 1136 |
| JBT1492 | 38 | A | Ac-LRYKWF[CGMRDMKGTMSC]VWVKF-NH2 | 1018 |
| JBT1493 | 51 | B | Ac-SLYKWF[CGMRDMKGTMSC]VWVKF-NH2 | 1060 |
| JBT1494 | 679 | D | Ac-SRLKWF[CGMRDMKGTMSC]VWVKF-NH2 | 1137 |
| JBT1495 | 729 | D | Ac-SRYLWF[CGMRDMKGTMSC]VWVKF-NH2 | 1138 |
| JBT1496 | >5000 | | Ac-SRYKLF[CGMRDMKGTMSC]VWVKF-NH2 | 1271 |
| JBT1497 | 72 | B | Ac-SRYKWL[CGMRDMKGTMSC]VWVKF-NH2 | 1061 |
| JBT1498 | >5000 | | Ac-SRYKWF[CLMRDMKGTMSC]VWVKF-NH2 | 1272 |
| JBT1499 | 636 | D | Ac-SRYKWF[CGLRDMKGTMSC]VWVKF-NH2 | 1139 |

FIGURE 34G

| Object ID | IC50 [nm] | Affinity Class | Sequence | SEQ ID NO: |
|---|---|---|---|---|
| JBT1500 | 68 | B | Ac-SRYKWF[CGMLDMKGTMSC]VWVKF-NH2 | 1062 |
| JBT1501 | 3449 | E | Ac-SRYKWF[CGMRLMKGTMSC]VWVKF-NH2 | 1185 |
| JBT1502 | 38 | A | Ac-SRYKWF[CGMRDLKGTMSC]VWVKF-NH2 | 1019 |
| JBT1503 | 54 | B | Ac-SRYKWF[CGMRDMLGTMSC]VWVKF-NH2 | 1063 |
| JBT1504 | 757 | D | Ac-SRYKWF[CGMRDMKLTMSC]VWVKF-NH2 | 1140 |
| JBT1505 | 155 | C | Ac-SRYKWF[CGMRDMKGLMSC]VWVKF-NH2 | 1092 |
| JBT1506 | 57 | B | Ac-SRYKWF[CGMRDMKGTLSC]VWVKF-NH2 | 1064 |
| JBT1507 | 411 | D | Ac-SRYKWF[CGMRDMKGTMLC]VWVKF-NH2 | 10141 |
| JBT1508 | 216 | C | Ac-SRYKWF[CGMRDMKGTMSC]LWVKF-NH2 | 1093 |
| JBT1509 | >5000 | | Ac-SRYKWF[CGMRDMKGTMSC]VLVKF-NH2 | 1273 |
| JBT1510 | 221 | C | Ac-SRYKWF[CGMRDMKGTMSC]VWLKF-NH2 | 1094 |
| JBT1511 | 330 | D | Ac-SRYKWF[CGMRDMKGTMSC]VWVLF-NH2 | 1142 |
| JBT1512 | 18 | A | Ac-SRYKWF[CGMRDMKGTMSC]VWVKL-NH2 | 1020 |
| JBT1513 | 56 | B | Ac-SSYKWF[CGMRDMKGTMSC]VWVKF-NH2 | 1065 |
| JBT1514 | 92 | B | Ac-SRSKWF[CGMRDMKGTMSC]VWVKF-NH2 | 1066 |
| JBT1515 | 411 | D | Ac-SRYSWF[CGMRDMKGTMSC]VWVKF-NH2 | 1143 |
| JBT1516 | >5000 | | Ac-SRYKSF[CGMRDMKGTMSC]VWVKF-NH2 | 1274 |
| JBT1517 | >5000 | | Ac-SRYKWS[CGMRDMKGTMSC]VWVKF-NH2 | 1275 |
| JBT1518 | 50 | A | Ac-SRYKWF[CSMRDMKGTMSC]VWVKF-NH2 | 1021 |
| JBT1519 | 1825 | E | Ac-SRYKWF[CGSRDMKGTMSC]VWVKF-NH2 | 1186 |
| JBT1520 | 202 | C | Ac-SRYKWF[CGMSDMKGTMSC]VWVKF-NH2 | 1095 |
| JBT1521 | 226 | C | Ac-SRYKWF[CGMRSMKGTMSC]VWVKF-NH2 | 1096 |
| JBT1522 | 92 | B | Ac-SRYKWF[CGMRDSKGTMSC]VWVKF-NH2 | 1067 |
| JBT1523 | 35 | A | Ac-SRYKWF[CGMRDMSGTMSC]VWVKF-NH2 | 1022 |
| JBT1524 | 512 | D | Ac-SRYKWF[CGMRDMKSTMSC]VWVKF-NH2 | 1144 |
| JBT1525 | 56 | B | Ac-SRYKWF[CGMRDMKGSMSC]VWVKF-NH2 | 1068 |
| JBT1526 | 80 | B | Ac-SRYKWF[CGMRDMKGTSSC]VWVKF-NH2 | 1069 |
| JBT1527 | 190 | C | Ac-SRYKWF[CGMRDMKGTMSC]SWVKF-NH2 | 1097 |
| JBT1528 | >5000 | | Ac-SRYKWF[CGMRDMKGTMSC]VSVKF-NH2 | 1276 |
| JBT1529 | >5000 | | Ac-SRYKWF[CGMRDMKGTMSC]VWSKF-NH2 | 1277 |
| JBT1530 | 83 | B | Ac-SRYKWF[CGMRDMKGTMSC]VWVSF-NH2 | 1070 |
| JBT1531 | 63 | B | Ac-SRYKWF[CGMRDMKGTMSC]VWVKS-NH2 | 1071 |

FIGURE 34H

| Object ID | IC50 [nm] | Affinity Class | Sequence | SEQ ID NO: |
|---|---|---|---|---|
| JBT1532 | 54 | B | Ac-PRYKWF[CGMRDMKGTMSC]VWVKF-NH2 | 1072 |
| JBT1533 | 263 | D | Ac-SPYKWF[CGMRDMKGTMSC]VWVKF-NH2 | 1145 |
| JBT1534 | 2398 | E | Ac-SRPKWF[CGMRDMKGTMSC]VWVKF-NH2 | 1187 |
| JBT1535 | >5000 | | Ac-SRYPWF[CGMRDMKGTMSC]VWVKF-NH2 | 1278 |
| JBT1536 | >5000 | | Ac-SRYKPF[CGMRDMKGTMSC]VWVKF-NH2 | 1279 |
| JBT1537 | >5000 | | Ac-SRYKWP[CGMRDMKGTMSC]VWVKF-NH2 | 1280 |
| JBT1538 | >5000 | | Ac-SRYKWF[CGMRDMKGTMSC]PWVKF-NH2 | 1281 |
| JBT1539 | >5000 | | Ac-SRYKWF[CGMRDMKGTMSC]VPVKF-NH2 | 1282 |
| JBT1540 | >5000 | | Ac-SRYKWF[CGMRDMKGTMSC]VWPKF-NH2 | 1283 |
| JBT1541 | 29 | A | Ac-SRYKWF[CGMRDMKGTMSC]VWVPF-NH2 | 1023 |
| JBT1542 | 1052 | E | Ac-SRYKWF[CGMRDMKGTMSC]VWVKP-NH2 | 1188 |
| JBT1543 | 202 | C | Ac-SRYKWF[CGMRDMKGTMSC]VWVKF-OH | 1098 |
| JBT1544 | 40 | A | H-SRYKWF[CGMRDMKGTMSC]VWVKF-NH2 | 1024 |
| JBT1545 | 239 | C | H-SRYKWF[CGMRDMKGTMSC]VWVKF-OH | 1099 |
| JBT1546 | >5000 | | Ac-SRYKWF[CEMRDMKGTMSC]VWVKF-NH2 | 1284 |
| JBT1547 | >5000 | | Ac-SRYKWF[CHMRDMKGTMSC]VWVKF-NH2 | 1285 |
| JBT1548 | >5000 | | Ac-SRYKWF[CIMRDMKGTMSC]VWVKF-NH2 | 1286 |
| JBT1549 | 1736 | E | Ac-SRYKWF[CMMRDMKGTMSC]VWVKF-NH2 | 1189 |
| JBT1550 | 1086 | E | Ac-SRYKWF[CNMRDMKGTMSC]VWVKF-NH2 | 1190 |
| JBT1551 | 682 | D | Ac-SRYKWF[CQMRDMKGTMSC]VWVKF-NH2 | 1146 |
| JBT1552 | 400 | D | Ac-SRYKWF[CRMRDMKGTMSC]VWVKF-NH2 | 1147 |
| JBT1553 | 292 | D | Ac-SRYKWF[CTMRDMKGTMSC]VWVKF-NH2 | 1148 |
| JBT1554 | >5000 | | Ac-SRYKWF[CVMRDMKGTMSC]VWVKF-NH2 | 1287 |
| JBT1555 | 3382 | E | Ac-SRYKWF[CWMRDMKGTMSC]VWVKF-NH2 | 1191 |
| JBT1556 | >5000 | | Ac-SRYKWF[CYMRDMKGTMSC]VWVKF-NH2 | 1288 |
| JBT1557 | 60 | B | H-RYKWF[CGMRDMKGTMSC]VWVKF-NH2 | 173 |
| JBT1558 | 975 | D | H-YKWF[CGMRDMKGTMSC]VWVKF-NH2 | 1149 |
| JBT1559 | 286 | D | Ac-SRYKWF[CGaRDMKGTMSC]VWVKF-NH2 | 1150 |
| JBT1560 | >5000 | | Ac-SRYKWF[CGdRDMKGTMSC]VWVKF-NH2 | 1289 |
| JBT1561 | 3031 | E | Ac-SRYKWF[CGfRDMKGTMSC]VWVKF-NH2 | 1192 |
| JBT1562 | 1783 | E | Ac-SRYKWF[CGkRDMKGTMSC]VWVKF-NH2 | 1193 |
| JBT1563 | 1821 | E | Ac-SRYKWF[CGlRDMKGTMSC]VWVKF-NH2 | 1194 |

FIGURE 34I

| Object ID | IC50 [nm] | Affinity Class | Sequence | SEQ ID NO: |
|---|---|---|---|---|
| JBT1564 | 170 | C | Ac-SRYKWF[CGpRDMKGTMSC]VWVKF-NH2 | 1100 |
| JBT1565 | 1712 | E | Ac-SRYKWF[CGsRDMKGTMSC]VWVKF-NH2 | 1195 |
| JBT1566 | 367 | D | Ac-SRYKWF[CGMRDaKGTMSC]VWVKF-NH2 | 1151 |
| JBT1567 | 212 | C | Ac-SRYKWF[CGMRDdKGTMSC]VWVKF-NH2 | 1101 |
| JBT1568 | 73 | B | Ac-SRYKWF[CGMRDfKGTMSC]VWVKF-NH2 | 1074 |
| JBT1569 | 155 | C | Ac-SRYKWF[CGMRDkKGTMSC]VWVKF-NH2 | 1102 |
| JBT1570 | 47 | A | Ac-SRYKWF[CGMRDlKGTMSC]VWVKF-NH2 | 1025 |
| JBT1571 | 1320 | E | Ac-SRYKWF[CGMRDpKGTMSC]VWVKF-NH2 | 1196 |
| JBT1572 | 650 | D | Ac-SRYKWF[CGMRDsKGTMSC]VWVKF-NH2 | 1152 |
| JBT1573 | 1154 | E | Ac-SRYKWF[CGMRDMaGTMSC]VWVKF-NH2 | 1197 |
| JBT1574 | 350 | D | Ac-SRYKWF[CGMRDMdGTMSC]VWVKF-NH2 | 1153 |
| JBT1575 | 2377 | E | Ac-SRYKWF[CGMRDMfGTMSC]VWVKF-NH2 | 1198 |
| JBT1576 | 1004 | E | Ac-SRYKWF[CGMRDMlGTMSC]VWVKF-NH2 | 1199 |
| JBT1577 | 1121 | E | Ac-SRYKWF[CGMRDMpGTMSC]VWVKF-NH2 | 1200 |
| JBT1578 | 633 | D | Ac-SRYKWF[CGMRDMsGTMSC]VWVKF-NH2 | 1154 |
| JBT1735 | 9 | A | Ac-SMYKWH[CGMRDMKGTYSC]VWVKF-NH2 | 1026 |
| JBT1772 | 11 | A | Ac-FHYKWH[CGMRDMKGTYSC]VWVKF-NH2 | 1027 |
| JBT1808 | 12 | A | Ac-SYYKWH[CGMRDMKGIMSC]AWVKF-NH2 | 1028 |
| JBT1811 | 11 | A | Ac-SYYKWH[CGMRDMKGIMSC]VWVKY-NH2 | 1029 |
| JBT1812 | 11 | A | Ac-SYYKWH[CGMRDMKGIDSC]VWVRF-NH2 | 1030 |
| JBT1813 | 9 | A | Ac-SYYKWH[CGMRDMKGIMSC]VWVKA-NH2 | 1031 |
| JBT1815 | 10 | A | Ac-SYYKWH[CGMRDMKGTMTC]VWVKF-NH2 | 1032 |
| JBT1816 | 9 | A | Ac-SYYKWH[CGMRDMKGTMSC]VWVKS-NH2 | 1033 |
| JBT1817 | 9 | A | Ac-SHYKWH[CAMRDMKGTYSC]VWVKF-NH2 | 1034 |
| JBT1821 | 11 | A | Ac-SYYKWH[CGVRDMKGTMSC]VWVKS-NH2 | 1035 |
| JBT1822 | 18 | A | Ac-GHYKWH[CGMRDMKGTFSC]VWVF-NH2 | 1036 |
| JBT1825 | 11 | A | Ac-AYYKWH[CGMRDLKGTMSC]VWVKS-NH2 | 1037 |
| JBT1826 | 11 | A | Ac-SYYKWH[CGMRDMKGTYSC]VWVKM-NH2 | 1038 |
| JBT1828 | 22 | A | Ac-SHYKWH[CGMRDMKGIMSC]VWVF-NH2 | 1039 |
| JBT1829 | 8 | A | Ac-FYYKWH[CGMRDMKGTMSC]AWVKF-NH2 | 1040 |
| JBT1830 | 10 | A | Ac-SYYKWH[CGMRDMKGTDSC]VWVWY-NH2 | 1041 |
| JBT1831 | 13 | A | Ac-SHYKWH[CGMRDMKGTMSC]AWVKF-NH2 | 1042 |

FIGURE 34J

| Object ID | IC50 [nm] | Affinity Class | Sequence | SEQ ID NO: |
|---|---|---|---|---|
| JBT1832 | 11 | A | Ac-HYYKWH[CGMRDMKGTMSC]VWVKS-NH2 | 1043 |
| JBT1837 | 10 | A | Ac-SYYKWH[CAMRDMKGTMTC]VWVKF-NH2 | 1044 |
| JBT1840 | 11 | A | Ac-SYYKWH[CGMRDMKGTMSC]VWVLF-NH2 | 1045 |
| JBT1842 | 9 | A | Ac-SHYKWH[CAMRDMKGTMSC]AWVKF-NH2 | 1046 |

FIGURE 35

| Object ID | EC50(nM) | Sequence | SEQ ID NO: |
|---|---|---|---|
| JBT0124 | 1.8 | Biotinyl-Ttds-SGASRYKWF[CGMRDMKGTMSC]VWVKFRYDTS-NH2 | 1290 |
| JBT0659 | 2.1 | Biotinyl-Ttds-SRYKWF[CGMRDMKGTMSC]VWVKF-NH2 | 1291 |

FIGURE 36A

| Object ID | IC50 [nM] | Affinity Class | Sequence | SEQ ID NO: |
|---|---|---|---|---|
| JBT0122 | 3084 | E | Ac-SGYASFPLAVQLHVSKRSKEMALARLYYKTS-NH2 | 2002 |
| JBT0221 | 1412 | E | Ac-KKSGYASFPLAVQLHVSKRSKEMALARLYYKTSKK-NH2 | 2003 |
| JBT0222* | 36272 | G | Ac-MKSRSLGLAYFAKHSSLEVLQTRKVAAPYY-NH2 | 2127 |
| JBT0223* | >50000 | | Ac-KMQLRVYASTAHSRYLLGSSLFPKYAEVKA-NH2 | 2297 |
| JBT0224 | >50000 | | Ac-KKSGYASFPLAVQLHVSKRSKEMALARLYYKK-NH2 | 2298 |
| JBT0225 | 25395 | G | Ac-KKSGYASFPLAVQLHVSKRSKEMALARKK-NH2 | 2128 |
| JBT0226 | >50000 | | Ac-KKSGYASFPLAVQLHVSKRSKEMAKK-NH2 | 2299 |
| JBT0227 | >50000 | | Ac-KKSGYASFPLAVQLHVSKRSKKK-NH2 | 2300 |
| JBT0228 | 5436 | F | Ac-KKASFPLAVQLHVSKRSKEMALARLYYKTSKK-NH2 | 2016 |
| JBT0229 | 16971 | G | Ac-KKPLAVQLHVSKRSKEMALARLYYKTSKK-NH2 | 2129 |
| JBT0230 | >50000 | | Ac-KKVQLHVSKRSKEMALARLYYKTSKK-NH2 | 2301 |
| JBT0231 | >50000 | | Ac-KKHVSKRSKEMALARLYYKTSKK-NH2 | 2302 |
| JBT0232 | >50000 | | Ac-KKGYASFPLAVQLHVSKRSKEMKK-NH2 | 2303 |
| JBT0233 | >50000 | | Ac-KKYASFPLAVQLHVSKRSKEMAKK-NH2 | 2304 |
| JBT0234 | >50000 | | Ac-KKVQLHVSKRSKEMALARLYYKKK-NH2 | 2305 |
| JBT0235 | >50000 | | Ac-KKQLHVSKRSKEMALARLYYKTKK-NH2 | 2306 |
| JBT0236 | >50000 | | Ac-KKLHVSKRSKEMALARLYYKTSKK-NH2 | 2307 |
| JBT0237 | >50000 | | Ac-KKSGYASFPLAVQLHVSKRSKEKK-NH2 | 2308 |
| JBT0359 | >50000 | | Ac-ASFPLAVQLHVSKRSKEMA-NH2 | 2309 |
| JBT0360 | >50000 | | Ac-SFPLAVQLHVSKRSKEMA-NH2 | 2310 |
| JBT0361 | >50000 | | Ac-FPLAVQLHVSKRSKEMA-NH2 | 2311 |
| JBT0362 | >50000 | | Ac-ASFPLAVQLHVSKRSKEM-NH2 | 2312 |
| JBT0363 | >50000 | | Ac-ASFPLAVQLHVSKRSKE-NH2 | 2313 |
| JBT0364 | >50000 | | Ac-ASFPLAVQLHVSKRSKEMAL-NH2 | 2314 |
| JBT0365 | >50000 | | Ac-ASFPLAVQLHVSKRSKEMALA-NH2 | 2315 |
| JBT0366 | >50000 | | Ac-ASFPLAVQLHVSKRSKEMALAR-NH2 | 2316 |
| JBT0367 | >50000 | | Ac-ASFPLAVQLHVSKRSKEMALARL-NH2 | 2317 |
| JBT0368 | 27346 | G | Ac-ASFPLAVQLHVSKRSKEMALARLY-NH2 | 2130 |
| JBT0369 | 5107 | F | Ac-ASFPLAVQLHVSKRSKEMALARLYY-NH2 | 2017 |
| JBT0370 | >50000 | | Ac-YASFPLAVQLHVSKRSKEMA-NH2 | 2318 |
| JBT0371 | >50000 | | Ac-GYASFPLAVQLHVSKRSKEMA-NH2 | 2319 |
| JBT0660 | 2645 | E | Ac-AGYASFPLAVQLHVSKRSKEMALARLYYKTS-NH2 | 2004 |

FIGURE 36B

| Object ID | IC50 [nM] | Affinity Class | Sequence | SEQ ID NO: |
|---|---|---|---|---|
| JBT0661 | 1383 | E | Ac-SAYASFPLAVQLHVSKRSKEMALARLYYKTS-NH2 | 2005 |
| JBT0662 | 13759 | G | Ac-SGAASFPLAVQLHVSKRSKEMALARLYYKTS-NH2 | 2131 |
| JBT0664 | 2739 | E | Ac-SGYAAFPLAVQLHVSKRSKEMALARLYYKTS-NH2 | 2006 |
| JBT0665 | 25704 | G | Ac-SGYASAPLAVQLHVSKRSKEMALARLYYKTS-NH2 | 2132 |
| JBT0666 | 915 | D | Ac-SGYASFALAVQLHVSKRSKEMALARLYYKTS-NH2 | 2001 |
| JBT0667 | 9314 | F | Ac-SGYASFPAAVQLHVSKRSKEMALARLYYKTS-NH2 | 2018 |
| JBT0669 | 33021 | G | Ac-SGYASFPLAAQLHVSKRSKEMALARLYYKTS-NH2 | 2133 |
| JBT0670 | 2506 | E | Ac-SGYASFPLAVALHVSKRSKEMALARLYYKTS-NH2 | 2007 |
| JBT0671 | 5836 | F | Ac-SGYASFPLAVQAHVSKRSKEMALARLYYKTS-NH2 | 2019 |
| JBT0672 | 38327 | G | Ac-SGYASFPLAVQLAVSKRSKEMALARLYYKTS-NH2 | 2134 |
| JBT0673 | 16425 | G | Ac-SGYASFPLAVQLHASKRSKEMALARLYYKTS-NH2 | 2135 |
| JBT0674 | 1173 | E | Ac-SGYASFPLAVQLHVAKRSKEMALARLYYKTS-NH2 | 2008 |
| JBT0675 | 18317 | G | Ac-SGYASFPLAVQLHVSARSKEMALARLYYKTS-NH2 | 2136 |
| JBT0676 | 37412 | G | Ac-SGYASFPLAVQLHVSKASKEMALARLYYKTS-NH2 | 2137 |
| JBT0677 | 1905 | E | Ac-SGYASFPLAVQLHVSKRAKEMALARLYYKTS-NH2 | 2009 |
| JBT0678 | 4071 | E | Ac-SGYASFPLAVQLHVSKRSAEMALARLYYKTS-NH2 | 2010 |
| JBT0679 | 6196 | F | Ac-SGYASFPLAVQLHVSKRSKAMALARLYYKTS-NH2 | 2020 |
| JBT0680 | 20935 | G | Ac-SGYASFPLAVQLHVSKRSKEAALARLYYKTS-NH2 | 2138 |
| JBT0682 | 10271 | G | Ac-SGYASFPLAVQLHVSKRSKEMAAARLYYKTS-NH2 | 2139 |
| JBT0684 | 4567 | E | Ac-SGYASFPLAVQLHVSKRSKEMALAALYYKTS-NH2 | 2011 |
| JBT0685 | 9134 | F | Ac-SGYASFPLAVQLHVSKRSKEMALARAYYKTS-NH2 | 2021 |
| JBT0686 | 13474 | G | Ac-SGYASFPLAVQLHVSKRSKEMALARLAYKTS-NH2 | 2140 |
| JBT0687 | 11783 | G | Ac-SGYASFPLAVQLHVSKRSKEMALARLYAKTS-NH2 | 2141 |
| JBT0688 | 4196 | E | Ac-SGYASFPLAVQLHVSKRSKEMALARLYYATS-NH2 | 2012 |
| JBT0689 | 3127 | E | Ac-SGYASFPLAVQLHVSKRSKEMALARLYYKAS-NH2 | 2013 |
| JBT0690 | 3000 | E | Ac-SGYASFPLAVQLHVSKRSKEMALARLYYKTA-NH2 | 2014 |
| JBT0788 | 16205 | G | H-GSSGYASFPLAVQLHVSKRSKEMALARLYYKTS-OH | 2142 |
| JBT1579 | 2593 | E | Ac-GYASFPLAVQLHVAKRSKEMA-NH2 | 2015 |
| JBT1580 | >50000 | | Ac-GYASFALSVQLHVSKRSKEMA-NH2 | 2320 |
| JBT1581 | >50000 | | Ac-GYASFALAVQLHVAKRSKEMA-NH2 | 2321 |
| JBT1582 | 5841 | F | Ac-GYASFPLAVQLHVMKRSKEMA-NH2 | 2022 |
| JBT1583 | >50000 | | Ac-GYASFALAVQLHVMKRSKEMA-NH2 | 2322 |

FIGURE 36C

| Object ID | IC50 [nM] | Affinity Class | Sequence | SEQ ID NO: |
|---|---|---|---|---|
| JBT1599 | >50000 | | Ac-FPLAVQLHVSKRSKEMALA-NH2 | 2323 |
| JBT1600 | >50000 | | Ac-QLHVSKRSKEMALA-NH2 | 2324 |
| JBT1601 | >50000 | | Ac-SGYASFP-NH2 | 2325 |
| JBT1602 | >50000 | | Ac-LAVQLHVSKRSKEMALARL-NH2 | 2326 |
| JBT1644 | | | Ac-VYASFFLTVQLHVSKRSKEMA-NH2 | 2327 |
| JBT1645 | | | Ac-GYWSFPQAVQLHVSKRSKEMA-NH2 | 2328 |
| JBT1646 | | | Ac-GYASFILAVQLHVSKRSKEMA-NH2 | 2329 |
| JBT1647 | | | Ac-GYWSFYLAVQLHVSKRSKEMA-NH2 | 2330 |
| JBT1648 | | | Ac-SYASFFLAVQLHVSKRSEEMA-NH2 | 2331 |
| JBT1649 | 10282 | G | Ac-GYWSFPHAVWHHVSKRSKEMA-NH2 | 2143 |
| JBT1650 | | | Ac-GYASFILAVQLHIIKRSKEMA-NH2 | 2332 |
| JBT1651 | | | Ac-GMASFFLARDLHWSKVFKEMA-NH2 | 2333 |
| JBT1653 | | | Ac-EYAQFWLAVQLHVSKRSKEMA-NH2 | 2334 |
| JBT1654 | | | Ac-GYASFPLIVQLHVSKRSKEMA-NH2 | 2335 |
| JBT1655 | | | Ac-GYASFPIHVQHHVSKRSKEMA-NH2 | 2336 |
| JBT1656 | | | Ac-GYASFALMVQLHVSKRSKEMA-NH2 | 2337 |
| JBT1657 | | | Ac-GYASFHQAVQRHVSKRSKEMA-NH2 | 2338 |
| JBT1658 | | | Ac-GYASFALMVQHHVSKRSKEMA-NH2 | 2339 |
| JBT1659 | 14473 | G | Ac-GYASFWQAVQLHVWKRSKEIA-NH2 | 2144 |
| JBT1660 | 14063 | G | Ac-GYASFPLIVWLHVSKRSKEMA-NH2 | 2145 |
| JBT1661 | | | Ac-GYASFSLAVQLHVSKRSKEMA-NH2 | 2340 |
| JBT1662 | | | Ac-GYHSFKLAVQLHVSKRSKEIA-NH2 | 2341 |
| JBT1663 | 12912 | G | Ac-GYASFWQAVQLHVSKRSKEIA-NH2 | 2146 |
| JBT1664 | | | Ac-GYASYVLAVQHHVSWRSWEMA-NH2 | 2342 |
| JBT1665 | | | Ac-HYHSLPKQVQLHVSKRSKEMA-NH2 | 2343 |
| JBT1666 | | | Ac-GYASFSLAVQLHVHKRSYEMA-NH2 | 2344 |
| JBT1668 | | | Ac-GYASFELLVQLHVSKRSKEMA-NH2 | 2345 |
| JBT1669 | | | Ac-SYSSFKLAVQLHVSKRSKEMA-NH2 | 2346 |
| JBT1670 | | | Ac-GYAWFPLNVWLHVHKRSHEMA-NH2 | 2347 |
| JBT1671 | | | Ac-GYASFWLSVQTHVSKRSKEMA-NH2 | 2348 |

FIGURE 36D

| Object ID | IC50 [nM] | Affinity Class | Sequence | SEQ ID NO: |
|---|---|---|---|---|
| JBT1672 | | | Ac-GYASFPLMVQLHVIKRSKEMA-NH2 | 2349 |
| JBT1673 | | | Ac-GYWSFNLVVQLHVSKRSKEMA-NH2 | 2350 |
| JBT1674 | | | Ac-GYASFHLAVQLHVWKRSKEMA-NH2 | 2351 |
| JBT1675 | | | Ac-GYASFWLVVQLHVSKRSKEMA-NH2 | 2352 |
| JBT1676 | | | Ac-GYWSFPLAVQLHVWKRSWEMA-NH2 | 2353 |
| JBT1677 | | | Ac-GYASFPWYVQLHVSKRSKEMA-NH2 | 2354 |
| JBT1678 | | | Ac-GYTSFQLAVQLHVSKRSKEMA-NH2 | 2355 |
| JBT1679 | | | Ac-RYASFPLAVYLHVTKRSKEMA-NH2 | 2356 |
| JBT1680 | | | Ac-GYWSFPLAVQLHVSKRLKEMA-NH2 | 2357 |
| JBT1681 | | | Ac-GHASFQTAVQQHVSKRSKEMA-NH2 | 2358 |
| JBT1682 | | | Ac-FHVSKRSKEMA-NH2 | 2359 |
| JBT1683 | | | Ac-GYASFWHAVQLHVSKRSKEMA-NH2 | 2360 |
| JBT1684 | | | Ac-GIASFILAVQLHVYKRSKEMA-NH2 | 2361 |
| JBT1685 | | | Ac-GYTSFMQAVQHHVSKRSKEIA-NH2 | 2362 |
| JBT1686 | | | Ac-HYHSFYLAVQLHVWERSYEMA-NH2 | 2363 |
| JBT1687 | | | Ac-GYASFWHAVQHHVTKRSREMA-NH2 | 2364 |
| JBT1688 | | | Ac-GYASFTLTVQLHVSKRSKEMA-NH2 | 2365 |
| JBT1689 | | | Ac-GYASFILTVQLHVSKRSKEMA-NH2 | 2366 |
| JBT1690 | | | Ac-GYASFWLAVQIHVSKRSKEMA-NH2 | 2367 |
| JBT1691 | | | Ac-GYASFILAVQHHVSKRSKEMA-NH2 | 2368 |
| JBT1692 | | | Ac-SYASFPPAVMLHVWKRSYEMA-NH2 | 2369 |
| JBT1693 | | | Ac-GYASFNLAVQLHVSKRSKEMA-NH2 | 2370 |
| JBT1694 | | | Ac-GYWSFNLAVQLHVSKRSKEMA-NH2 | 2371 |
| JBT1695 | | | Ac-GYASFFLAVQLHVSKRSKEMA-NH2 | 2372 |
| JBT1696 | | | Ac-GYASFWLAVQMHVWKRSKEMA-NH2 | 2373 |
| JBT1697 | 8481 | F | Ac-GYASFPWFVQLHVHKRSWEMA-NH2 | 223 |
| JBT1698 | | | Ac-GYASFSLAIQLHVSKRSKEMA-NH2 | 2374 |
| JBT1858 | | F | Ac-AYASFPWFVQLHVHKRSWEMA-NH2 | 2024 |
| JBT1859 | | | Ac-GAASFPWFVQLHVHKRSWEMA-NH2 | 2375 |
| JBT1860 | | F | Ac-GYAAFPWFVQLHVHKRSWEMA-NH2 | 2025 |

FIGURE 36E

| Object ID | IC50 [nM] | Affinity Class | Sequence | SEQ ID NO: |
|---|---|---|---|---|
| JBT1861 | | | Ac-GYASAPWFVQLHVHKRSWEMA-NH2 | 2376 |
| JBT1862 | | | Ac-GYASFAWFVQLHVHKRSWEMA-NH2 | 2377 |
| JBT1863 | | G | Ac-GYASFPAFVQLHVHKRSWEMA-NH2 | 2147 |
| JBT1864 | | F | Ac-GYASFPWAVQLHVHKRSWEMA-NH2 | 2026 |
| JBT1865 | | | Ac-GYASFPWFAQLHVHKRSWEMA-NH2 | 2378 |
| JBT1866 | | F | Ac-GYASFPWFVALHVHKRSWEMA-NH2 | 2027 |
| JBT1867 | | G | Ac-GYASFPWFVQAHVHKRSWEMA-NH2 | 2148 |
| JBT1868 | | | Ac-GYASFPWFVQLAVHKRSWEMA-NH2 | 2379 |
| JBT1869 | | G | Ac-GYASFPWFVQLHAHKRSWEMA-NH2 | 2149 |
| JBT1870 | | G | Ac-GYASFPWFVQLHVAKRSWEMA-NH2 | 2150 |
| JBT1871 | | | Ac-GYASFPWFVQLHVHARSWEMA-NH2 | 2380 |
| JBT1872 | | | Ac-GYASFPWFVQLHVHKASWEMA-NH2 | 2381 |
| JBT1874 | | | Ac-GYASFPWFVQLHVHKRSAEMA-NH2 | 2382 |
| JBT1875 | | G | Ac-GYASFPWFVQLHVHKRSWAMA-NH2 | 2151 |
| JBT1876 | | G | Ac-GYASFPWFVQLHVHKRSWEAA-NH2 | 2152 |
| JBT1877 | | F | Ac-CYASFPWFVQLHVHKRSWEMA-NH2 | 2028 |
| JBT1878 | | F | Ac-GCASFPWFVQLHVHKRSWEMA-NH2 | 2029 |
| JBT1879 | | F | Ac-GYCSFPWFVQLHVHKRSWEMA-NH2 | 2030 |
| JBT1880 | | F | Ac-GYACFPWFVQLHVHKRSWEMA-NH2 | 2031 |
| JBT1881 | | F | Ac-GYASCPWFVQLHVHKRSWEMA-NH2 | 2032 |
| JBT1882 | | G | Ac-GYASFCWFVQLHVHKRSWEMA-NH2 | 2153 |
| JBT1883 | | F | Ac-GYASFPCFVQLHVHKRSWEMA-NH2 | 2033 |
| JBT1884 | | F | Ac-GYASFPWCVQLHVHKRSWEMA-NH2 | 2034 |
| JBT1885 | | F | Ac-GYASFPWFCQLHVHKRSWEMA-NH2 | 2035 |
| JBT1886 | | F | Ac-GYASFPWFVCLHVHKRSWEMA-NH2 | 2236 |
| JBT1888 | | G | Ac-GYASFPWFVQLCVHKRSWEMA-NH2 | 2154 |
| JBT1889 | | F | Ac-GYASFPWFVQLHCHKRSWEMA-NH2 | 2037 |
| JBT1890 | | F | Ac-GYASFPWFVQLHVCKRSWEMA-NH2 | 2038 |
| JBT1891 | | | Ac-GYASFPWFVQLHVHCRSWEMA-NH2 | 2383 |
| JBT1892 | | | Ac-GYASFPWFVQLHVHKCSWEMA-NH2 | 2384 |

FIGURE 36F

| Object ID | IC50 [nM] | Affinity Class | Sequence | SEQ ID NO: |
|---|---|---|---|---|
| JBT1893 | | F | Ac-GYASFPWFVQLHVHKRCWEMA-NH2 | 2039 |
| JBT1894 | | F | Ac-GYASFPWFVQLHVHKRSCEMA-NH2 | 2040 |
| JBT1895 | | F | Ac-GYASFPWFVQLHVHKRSWCMA-NH2 | 2041 |
| JBT1896 | | F | Ac-GYASFPWFVQLHVHKRSWECA-NH2 | 2042 |
| JBT1897 | | F | Ac-GYASFPWFVQLHVHKRSWEMC-NH2 | 2043 |
| JBT1898 | | F | Ac-DYASFPWFVQLHVHKRSWEMA-NH2 | 2044 |
| JBT1899 | | G | Ac-GDASFPWFVQLHVHKRSWEMA-NH2 | 2155 |
| JBT1900 | | G | Ac-GYDSFPWFVQLHVHKRSWEMA-NH2 | 2156 |
| JBT1901 | | G | Ac-GYADFPWFVQLHVHKRSWEMA-NH2 | 2157 |
| JBT1902 | | G | Ac-GYASDPWFVQLHVHKRSWEMA-NH2 | 2158 |
| JBT1903 | | | Ac-GYASFDWFVQLHVHKRSWEMA-NH2 | 2385 |
| JBT1904 | | | Ac-GYASFPDFVQLHVHKRSWEMA-NH2 | 2386 |
| JBT1905 | | | Ac-GYASFPWDVQLHVHKRSWEMA-NH2 | 2387 |
| JBT1906 | | | Ac-GYASFPWFDQLHVHKRSWEMA-NH2 | 2388 |
| JBT1907 | | | Ac-GYASFPWFVDLHVHKRSWEMA-NH2 | 2389 |
| JBT1908 | | | Ac-GYASFPWFVQDHVHKRSWEMA-NH2 | 2390 |
| JBT1909 | | | Ac-GYASFPWFVQLDVHKRSWEMA-NH2 | 2391 |
| JBT1910 | | | Ac-GYASFPWFVQLHDHKRSWEMA-NH2 | 2392 |
| JBT1911 | | | Ac-GYASFPWFVQLHVDKRSWEMA-NH2 | 2393 |
| JBT1912 | | | Ac-GYASFPWFVQLHVHDRSWEMA-NH2 | 2394 |
| JBT1913 | | | Ac-GYASFPWFVQLHVHKDSWEMA-NH2 | 2395 |
| JBT1914 | | | Ac-GYASFPWFVQLHVHKRDWEMA-NH2 | 2396 |
| JBT1915 | | | Ac-GYASFPWFVQLHVHKRSDEMA-NH2 | 2397 |
| JBT1916 | | G | Ac-GYASFPWFVQLHVHKRSWDMA-NH2 | 2159 |
| JBT1917 | | | Ac-GYASFPWFVQLHVHKRSWEDA-NH2 | 2398 |
| JBT1918 | | | Ac-GYASFPWFVQLHVHKRSWEMD-NH2 | 2399 |
| JBT1920 | | | Ac-GEASFPWFVQLHVHKRSWEMA-NH2 | 2400 |
| JBT1921 | | G | Ac-GYESFPWFVQLHVHKRSWEMA-NH2 | 2160 |
| JBT1922 | | G | Ac-GYAEFPWFVQLHVHKRSWEMA-NH2 | 2161 |
| JBT1923 | | | Ac-GYASEPWFVQLHVHKRSWEMA-NH2 | 2401 |

FIGURE 36G

| Object ID | IC50 [nM] | Affinity Class | Sequence | SEQ ID NO: |
|---|---|---|---|---|
| JBT1924 | | | Ac-GYASFEWFVQLHVHKRSWEMA-NH2 | 2402 |
| JBT1925 | | | Ac-GYASFPEFVQLHVHKRSWEMA-NH2 | 2403 |
| JBT1926 | | | Ac-GYASFPWEVQLHVHKRSWEMA-NH2 | 2404 |
| JBT1927 | | | Ac-GYASFPWFEQLHVHKRSWEMA-NH2 | 2405 |
| JBT1928 | | | Ac-GYASFPWFVELHVHKRSWEMA-NH2 | 2406 |
| JBT1929 | | | Ac-GYASFPWFVQEHVHKRSWEMA-NH2 | 2407 |
| JBT1930 | | | Ac-GYASFPWFVQLEVHKRSWEMA-NH2 | 2408 |
| JBT1931 | | | Ac-GYASFPWFVQLHEHKRSWEMA-NH2 | 2409 |
| JBT1932 | | | Ac-GYASFPWFVQLHVEKRSWEMA-NH2 | 2410 |
| JBT1933 | | | Ac-GYASFPWFVQLHVHERSWEMA-NH2 | 2411 |
| JBT1934 | | | Ac-GYASFPWFVQLHVHKESWEMA-NH2 | 2412 |
| JBT1935 | | | Ac-GYASFPWFVQLHVHKREWEMA-NH2 | 2413 |
| JBT1936 | | | Ac-GYASFPWFVQLHVHKRSEEMA-NH2 | 2414 |
| JBT1937 | | | Ac-GYASFPWFVQLHVHKRSWEEA-NH2 | 2415 |
| JBT1938 | | | Ac-GYASFPWFVQLHVHKRSWEME-NH2 | 2416 |
| JBT1939 | | G | Ac-FYASFPWFVQLHVHKRSWEMA-NH2 | 2162 |
| JBT1940 | | G | Ac-GFASFPWFVQLHVHKRSWEMA-NH2 | 2163 |
| JBT1941 | | G | Ac-GYFSFPWFVQLHVHKRSWEMA-NH2 | 2164 |
| JBT1942 | | G | Ac-GYAFFPWFVQLHVHKRSWEMA-NH2 | 2165 |
| JBT1943 | | | Ac-GYASFFWFVQLHVHKRSWEMA-NH2 | 2417 |
| JBT1944 | | G | Ac-GYASFPFFVQLHVHKRSWEMA-NH2 | 2166 |
| JBT1945 | | G | Ac-GYASFPWFFQLHVHKRSWEMA-NH2 | 2167 |
| JBT1946 | | G | Ac-GYASFPWFVFLHVHKRSWEMA-NH2 | 2168 |
| JBT1948 | | | Ac-GYASFPWFVQLFVHKRSWEMA-NH2 | 2418 |
| JBT1949 | | G | Ac-GYASFPWFVQLHFHKRSWEMA-NH2 | 2169 |
| JBT1950 | | F | Ac-GYASFPWFVQLHVFKRSWEMA-NH2 | 2045 |
| JBT1951 | | | Ac-GYASFPWFVQLHVHFRSWEMA-NH2 | 2419 |
| JBT1952 | | G | Ac-GYASFPWFVQLHVHKFSWEMA-NH2 | 2170 |
| JBT1953 | | G | Ac-GYASFPWFVQLHVHKRFWEMA-NH2 | 2171 |
| JBT1954 | | G | Ac-GYASFPWFVQLHVHKRSFEMA-NH2 | 2172 |

FIGURE 36H

| Object ID | IC50 [nM] | Affinity Class | Sequence | SEQ ID NO: |
|---|---|---|---|---|
| JBT1955 | | G | Ac-GYASFPWFVQLHVHKRSWFMA-NH2 | 2173 |
| JBT1956 | | G | Ac-GYASFPWFVQLHVHKRSWEFA-NH2 | 2174 |
| JBT1959 | | F | Ac-GYGSFPWFVQLHVHKRSWEMA-NH2 | 2046 |
| JBT1960 | | F | Ac-GYAGFPWFVQLHVHKRSWEMA-NH2 | 2047 |
| JBT1961 | | G | Ac-GYASGPWFVQLHVHKRSWEMA-NH2 | 2175 |
| JBT1962 | | | Ac-GYASFGWFVQLHVHKRSWEMA-NH2 | 2420 |
| JBT1963 | | G | Ac-GYASFPGFVQLHVHKRSWEMA-NH2 | 2176 |
| JBT1964 | | G | Ac-GYASFPWGVQLHVHKRSWEMA-NH2 | 2177 |
| JBT1965 | | G | Ac-GYASFPWFGQLHVHKRSWEMA-NH2 | 2178 |
| JBT1966 | | G | Ac-GYASFPWFVGLHVHKRSWEMA-NH2 | 2179 |
| JBT1967 | | G | Ac-GYASFPWFVQGHVHKRSWEMA-NH2 | 2180 |
| JBT1968 | | | Ac-GYASFPWFVQLGVHKRSWEMA-NH2 | 2421 |
| JBT1969 | | G | Ac-GYASFPWFVQLHGHKRSWEMA-NH2 | 2181 |
| JBT1970 | | G | Ac-GYASFPWFVQLHVGKRSWEMA-NH2 | 2182 |
| JBT1971 | | | Ac-GYASFPWFVQLHVHGRSWEMA-NH2 | 2422 |
| JBT1972 | | | Ac-GYASFPWFVQLHVHKGSWEMA-NH2 | 2423 |
| JBT1973 | | F | Ac-GYASFPWFVQLHVHKRGWEMA-NH2 | 2048 |
| JBT1974 | | | Ac-GYASFPWFVQLHVHKRSGEMA-NH2 | 2424 |
| JBT1975 | | G | Ac-GYASFPWFVQLHVHKRSWGMA-NH2 | 2183 |
| JBT1976 | | G | Ac-GYASFPWFVQLHVHKRSWEGA-NH2 | 2184 |
| JBT1979 | | G | Ac-GHASFPWFVQLHVHKRSWEMA-NH2 | 2185 |
| JBT1980 | | F | Ac-GYHSFPWFVQLHVHKRSWEMA-NH2 | 2049 |
| JBT1981 | | F | Ac-GYAHFPWFVQLHVHKRSWEMA-NH2 | 2050 |
| JBT1982 | | F | Ac-GYASHPWFVQLHVHKRSWEMA-NH2 | 2051 |
| JBT1984 | | G | Ac-GYASFPHFVQLHVHKRSWEMA-NH2 | 2186 |
| JBT1985 | | F | Ac-GYASFPWHVQLHVHKRSWEMA-NH2 | 2052 |
| JBT1986 | | G | Ac-GYASFPWFHQLHVHKRSWEMA-NH2 | 2187 |
| JBT1987 | | G | Ac-GYASFPWFVHLHVHKRSWEMA-NH2 | 2188 |
| JBT1989 | | G | Ac-GYASFPWFVQLHHHKRSWEMA-NH2 | 2189 |
| JBT1990 | | | Ac-GYASFPWFVQLHVHHRSWEMA-NH2 | 2425 |

FIGURE 36I

| Object ID | IC50 [nM] | Affinity Class | Sequence | SEQ ID NO: |
|---|---|---|---|---|
| JBT1991 | | | Ac-GYASFPWFVQLHVHKHSWEMA-NH2 | 2426 |
| JBT1993 | | | Ac-GYASFPWFVQLHVHKRSHEMA-NH2 | 2427 |
| JBT1994 | | F | Ac-GYASFPWFVQLHVHKRSWHMA-NH2 | 2053 |
| JBT1995 | | G | Ac-GYASFPWFVQLHVHKRSWEHA-NH2 | 2190 |
| JBT1996 | | F | Ac-GYASFPWFVQLHVHKRSWEMH-NH2 | 2054 |
| JBT1997 | | G | Ac-IYASFPWFVQLHVHKRSWEMA-NH2 | 2191 |
| JBT1999 | | F | Ac-GYISFPWFVQLHVHKRSWEMA-NH2 | 2055 |
| JBT2000 | | F | Ac-GYAIFPWFVQLHVHKRSWEMA-NH2 | 2056 |
| JBT2001 | | G | Ac-GYASIPWFVQLHVHKRSWEMA-NH2 | 2192 |
| JBT2002 | | | Ac-GYASFIWFVQLHVHKRSWEMA-NH2 | 2428 |
| JBT2003 | | G | Ac-GYASFPIFVQLHVHKRSWEMA-NH2 | 2193 |
| JBT2005 | | G | Ac-GYASFPWFIQLHVHKRSWEMA-NH2 | 2194 |
| JBT2006 | | G | Ac-GYASFPWFVILHVHKRSWEMA-NH2 | 2195 |
| JBT2007 | | F | Ac-GYASFPWFVQIHVHKRSWEMA-NH2 | 2057 |
| JBT2008 | | G | Ac-GYASFPWFVQLIVHKRSWEMA-NH2 | 2196 |
| JBT2010 | | F | Ac-GYASFPWFVQLHVIKRSWEMA-NH2 | 2058 |
| JBT2011 | | | Ac-GYASFPWFVQLHVHIRSWEMA-NH2 | 2429 |
| JBT2012 | | | Ac-GYASFPWFVQLHVHKISWEMA-NH2 | 2430 |
| JBT2013 | | F | Ac-GYASFPWFVQLHVHKRIWEMA-NH2 | 2059 |
| JBT2014 | | F | Ac-GYASFPWFVQLHVHKRSIEMA-NH2 | 2060 |
| JBT2017 | | F | Ac-GYASFPWFVQLHVHKRSWEMI-NH2 | 2061 |
| JBT2018 | | F | Ac-KYASFPWFVQLHVHKRSWEMA-NH2 | 2062 |
| JBT2019 | | F | Ac-GKASFPWFVQLHVHKRSWEMA-NH2 | 2063 |
| JBT2020 | | F | Ac-GYKSFPWFVQLHVHKRSWEMA-NH2 | 2064 |
| JBT2021 | | F | Ac-GYAKFPWFVQLHVHKRSWEMA-NH2 | 2065 |
| JBT2022 | | F | Ac-GYASKPWFVQLHVHKRSWEMA-NH2 | 2066 |
| JBT2023 | | G | Ac-GYASFKWFVQLHVHKRSWEMA-NH2 | 2197 |
| JBT2024 | | G | Ac-GYASFPKFVQLHVHKRSWEMA-NH2 | 2198 |
| JBT2025 | | F | Ac-GYASFPWKVQLHVHKRSWEMA-NH2 | 2067 |
| JBT2027 | | F | Ac-GYASFPWFVKLHVHKRSWEMA-NH2 | 2068 |

FIGURE 36J

| Object ID | IC50 [nM] | Affinity Class | Sequence | SEQ ID NO: |
|---|---|---|---|---|
| JBT2028 | | F | Ac-GYASFPWFVQKHVHKRSWEMA-NH2 | 2069 |
| JBT2029 | | G | Ac-GYASFPWFVQLKVHKRSWEMA-NH2 | 2199 |
| JBT2030 | | F | Ac-GYASFPWFVQLHKHKRSWEMA-NH2 | 2070 |
| JBT2032 | | | Ac-GYASFPWFVQLHVHKKSWEMA-NH2 | 2431 |
| JBT2033 | | F | Ac-GYASFPWFVQLHVHKRKWEMA-NH2 | 2071 |
| JBT2034 | | G | Ac-GYASFPWFVQLHVHKRSKEMA-NH2 | 2200 |
| JBT2035 | | F | Ac-GYASFPWFVQLHVHKRSWKMA-NH2 | 2072 |
| JBT2036 | | G | Ac-GYASFPWFVQLHVHKRSWEKA-NH2 | 2201 |
| JBT2037 | | F | Ac-GYASFPWFVQLHVHKRSWEMK-NH2 | 2073 |
| JBT2038 | | F | Ac-LYASFPWFVQLHVHKRSWEMA-NH2 | 2074 |
| JBT2040 | | F | Ac-GYLSFPWFVQLHVHKRSWEMA-NH2 | 2075 |
| JBT2041 | | F | Ac-GYALFPWFVQLHVHKRSWEMA-NH2 | 2076 |
| JBT2042 | | G | Ac-GYASLPWFVQLHVHKRSWEMA-NH2 | 2202 |
| JBT2043 | | | Ac-GYASFLWFVQLHVHKRSWEMA-NH2 | 2432 |
| JBT2044 | | G | Ac-GYASFPLFVQLHVHKRSWEMA-NH2 | 2203 |
| JBT2045 | | G | Ac-GYASFPWLVQLHVHKRSWEMA-NH2 | 2204 |
| JBT2046 | | G | Ac-GYASFPWFLQLHVHKRSWEMA-NH2 | 2205 |
| JBT2047 | | F | Ac-GYASFPWFVLLHVHKRSWEMA-NH2 | 2077 |
| JBT2048 | | G | Ac-GYASFPWFVQLLVHKRSWEMA-NH2 | 2206 |
| JBT2049 | | G | Ac-GYASFPWFVQLHLHKRSWEMA-NH2 | 2207 |
| JBT2050 | | G | Ac-GYASFPWFVQLHVLKRSWEMA-NH2 | 2208 |
| JBT2051 | | | Ac-GYASFPWFVQLHVHLRSWEMA-NH2 | 2433 |
| JBT2052 | | | Ac-GYASFPWFVQLHVHKLSWEMA-NH2 | 2434 |
| JBT2053 | | F | Ac-GYASFPWFVQLHVHKRLWEMA-NH2 | 2078 |
| JBT2054 | | G | Ac-GYASFPWFVQLHVHKRSLEMA-NH2 | 2209 |
| JBT2055 | | G | Ac-GYASFPWFVQLHVHKRSWLMA-NH2 | 2210 |
| JBT2056 | | G | Ac-GYASFPWFVQLHVHKRSWELA-NH2 | 2211 |
| JBT2057 | | F | Ac-GYASFPWFVQLHVHKRSWEML-NH2 | 2079 |
| JBT2058 | | F | Ac-MYASFPWFVQLHVHKRSWEMA-NH2 | 2080 |
| JBT2059 | | G | Ac-GMASFPWFVQLHVHKRSWEMA-NH2 | 2212 |

FIGURE 36K

| Object ID | IC50 [nM] | Affinity Class | Sequence | SEQ ID NO: |
|---|---|---|---|---|
| JBT2060 | | F | Ac-GYMSFPWFVQLHVHKRSWEMA-NH2 | 2081 |
| JBT2061 | | F | Ac-GYAMFPWFVQLHVHKRSWEMA-NH2 | 2082 |
| JBT2062 | | G | Ac-GYASMPWFVQLHVHKRSWEMA-NH2 | 2213 |
| JBT2063 | | | Ac-GYASFMWFVQLHVHKRSWEMA-NH2 | 2435 |
| JBT2064 | | | Ac-GYASFPMFVQLHVHKRSWEMA-NH2 | 2436 |
| JBT2065 | | G | Ac-GYASFPWMVQLHVHKRSWEMA-NH2 | 2214 |
| JBT2066 | | G | Ac-GYASFPWFMQLHVHKRSWEMA-NH2 | 2215 |
| JBT2067 | | G | Ac-GYASFPWFVMLHVHKRSWEMA-NH2 | 2216 |
| JBT2068 | | F | Ac-GYASFPWFVQMHVHKRSWEMA-NH2 | 2083 |
| JBT2069 | | | Ac-GYASFPWFVQLMVHKRSWEMA-NH2 | 2437 |
| JBT2070 | | G | Ac-GYASFPWFVQLHMHKRSWEMA-NH2 | 2217 |
| JBT2071 | | G | Ac-GYASFPWFVQLHVMKRSWEMA-NH2 | 2218 |
| JBT2072 | | | Ac-GYASFPWFVQLHVHMRSWEMA-NH2 | 2438 |
| JBT2073 | | | Ac-GYASFPWFVQLHVHKMSWEMA-NH2 | 2439 |
| JBT2075 | | G | Ac-GYASFPWFVQLHVHKRSMEMA-NH2 | 2219 |
| JBT2076 | | | Ac-GYASFPWFVQLHVHKRSWMMA-NH2 | 2440 |
| JBT2077 | | F | Ac-GYASFPWFVQLHVHKRSWEMM-NH2 | 2084 |
| JBT2078 | | F | Ac-NYASFPWFVQLHVHKRSWEMA-NH2 | 2085 |
| JBT2079 | | G | Ac-GNASFPWFVQLHVHKRSWEMA-NH2 | 2220 |
| JBT2080 | | G | Ac-GYNSFPWFVQLHVHKRSWEMA-NH2 | 2221 |
| JBT2081 | | F | Ac-GYANFPWFVQLHVHKRSWEMA-NH2 | 2086 |
| JBT2082 | | G | Ac-GYASNPWFVQLHVHKRSWEMA-NH2 | 2222 |
| JBT2083 | | | Ac-GYASFNWFVQLHVHKRSWEMA-NH2 | 2441 |
| JBT2084 | | G | Ac-GYASFPNFVQLHVHKRSWEMA-NH2 | 2223 |
| JBT2085 | | G | Ac-GYASFPWNVQLHVHKRSWEMA-NH2 | 2224 |
| JBT2086 | | | Ac-GYASFPWFNQLHVHKRSWEMA-NH2 | 2442 |
| JBT2087 | | G | Ac-GYASFPWFVNLHVHKRSWEMA-NH2 | 2225 |
| JBT2088 | | G | Ac-GYASFPWFVQNHVHKRSWEMA-NH2 | 2226 |
| JBT2089 | | | Ac-GYASFPWFVQLNVHKRSWEMA-NH2 | 2443 |
| JBT2090 | | | Ac-GYASFPWFVQLHNHKRSWEMA-NH2 | 2444 |

FIGURE 36L

| Object ID | IC50 [nM] | Affinity Class | Sequence | SEQ ID NO: |
|---|---|---|---|---|
| JBT2091 | | G | Ac-GYASFPWFVQLHVNKRSWEMA-NH2 | 2227 |
| JBT2092 | | | Ac-GYASFPWFVQLHVHNRSWEMA-NH2 | 2445 |
| JBT2093 | | | Ac-GYASFPWFVQLHVHKNSWEMA-NH2 | 2446 |
| JBT2094 | | F | Ac-GYASFPWFVQLHVHKRNWEMA-NH2 | 2087 |
| JBT2095 | | | Ac-GYASFPWFVQLHVHKRSNEMA-NH2 | 2447 |
| JBT2096 | | G | Ac-GYASFPWFVQLHVHKRSWNMA-NH2 | 2228 |
| JBT2097 | | G | Ac-GYASFPWFVQLHVHKRSWENA-NH2 | 2229 |
| JBT2098 | | F | Ac-GYASFPWFVQLHVHKRSWEMN-NH2 | 2088 |
| JBT2099 | | F | Ac-PYASFPWFVQLHVHKRSWEMA-NH2 | 2089 |
| JBT2100 | | G | Ac-GPASFPWFVQLHVHKRSWEMA-NH2 | 2230 |
| JBT2101 | | G | Ac-GYPSFPWFVQLHVHKRSWEMA-NH2 | 2231 |
| JBT2103 | | G | Ac-GYASPPWFVQLHVHKRSWEMA-NH2 | 2232 |
| JBT2104 | | | Ac-GYASFPPFVQLHVHKRSWEMA-NH2 | 2448 |
| JBT2105 | | G | Ac-GYASFPWPVQLHVHKRSWEMA-NH2 | 2233 |
| JBT2106 | | | Ac-GYASFPWFPQLHVHKRSWEMA-NH2 | 2449 |
| JBT2107 | | G | Ac-GYASFPWFVPLHVHKRSWEMA-NH2 | 2234 |
| JBT2108 | | | Ac-GYASFPWFVQPHVHKRSWEMA-NH2 | 2450 |
| JBT2109 | | | Ac-GYASFPWFVQLPVHKRSWEMA-NH2 | 2451 |
| JBT2110 | | | Ac-GYASFPWFVQLHPHKRSWEMA-NH2 | 2452 |
| JBT2111 | | | Ac-GYASFPWFVQLHVPKRSWEMA-NH2 | 2453 |
| JBT2112 | | | Ac-GYASFPWFVQLHVHPRSWEMA-NH2 | 2454 |
| JBT2113 | | | Ac-GYASFPWFVQLHVHKPSWEMA-NH2 | 2455 |
| JBT2114 | | | Ac-GYASFPWFVQLHVHKRPWEMA-NH2 | 2456 |
| JBT2115 | | | Ac-GYASFPWFVQLHVHKRSPEMA-NH2 | 2457 |
| JBT2116 | | G | Ac-GYASFPWFVQLHVHKRSWPMA-NH2 | 2235 |
| JBT2118 | | G | Ac-GYASFPWFVQLHVHKRSWEMP-NH2 | 2236 |
| JBT2119 | | G | Ac-QYASFPWFVQLHVHKRSWEMA-NH2 | 2237 |
| JBT2120 | | | Ac-GQASFPWFVQLHVHKRSWEMA-NH2 | 2458 |
| JBT2121 | | G | Ac-GYQSFPWFVQLHVHKRSWEMA-NH2 | 2238 |
| JBT2122 | | G | Ac-GYAQFPWFVQLHVHKRSWEMA-NH2 | 2239 |

FIGURE 36M

| Object ID | IC50 [nM] | Affinity Class | Sequence | SEQ ID NO: |
|---|---|---|---|---|
| JBT2123 | | G | Ac-GYASQPWFVQLHVHKRSWEMA-NH2 | 2240 |
| JBT2124 | | | Ac-GYASFQWFVQLHVHKRSWEMA-NH2 | 2459 |
| JBT2125 | | | Ac-GYASFPQFVQLHVHKRSWEMA-NH2 | 2460 |
| JBT2126 | | G | Ac-GYASFPWQVQLHVHKRSWEMA-NH2 | 2241 |
| JBT2127 | | | Ac-GYASFPWFQQLHVHKRSWEMA-NH2 | 2461 |
| JBT2128 | | G | Ac-GYASFPWFVQQHVHKRSWEMA-NH2 | 2242 |
| JBT2129 | | | Ac-GYASFPWFVQLQVHKRSWEMA-NH2 | 2462 |
| JBT2130 | | | Ac-GYASFPWFVQLHQHKRSWEMA-NH2 | 2463 |
| JBT2131 | | G | Ac-GYASFPWFVQLHVQKRSWEMA-NH2 | 2243 |
| JBT2132 | | | Ac-GYASFPWFVQLHVHQRSWEMA-NH2 | 2464 |
| JBT2133 | | | Ac-GYASFPWFVQLHVHKQSWEMA-NH2 | 2465 |
| JBT2134 | | F | Ac-GYASFPWFVQLHVHKRQWEMA-NH2 | 2090 |
| JBT2135 | | G | Ac-GYASFPWFVQLHVHKRSQEMA-NH2 | 2244 |
| JBT2136 | | G | Ac-GYASFPWFVQLHVHKRSWQMA-NH2 | 2245 |
| JBT2137 | | G | Ac-GYASFPWFVQLHVHKRSWEQA-NH2 | 2246 |
| JBT2138 | | F | Ac-GYASFPWFVQLHVHKRSWEMQ-NH2 | 2091 |
| JBT2139 | | F | Ac-RYASFPWFVQLHVHKRSWEMA-NH2 | 2092 |
| JBT2140 | | F | Ac-GRASFPWFVQLHVHKRSWEMA-NH2 | 2093 |
| JBT2141 | | F | Ac-GYRSFPWFVQLHVHKRSWEMA-NH2 | 2094 |
| JBT2142 | | F | Ac-GYARFPWFVQLHVHKRSWEMA-NH2 | 2095 |
| JBT2143 | | F | Ac-GYASRPWFVQLHVHKRSWEMA-NH2 | 2096 |
| JBT2144 | | G | Ac-GYASFRWFVQLHVHKRSWEMA-NH2 | 2247 |
| JBT2145 | | F | Ac-GYASFPRFVQLHVHKRSWEMA-NH2 | 2097 |
| JBT2146 | | F | Ac-GYASFPWRVQLHVHKRSWEMA-NH2 | 2098 |
| JBT2147 | | F | Ac-GYASFPWFRQLHVHKRSWEMA-NH2 | 2099 |
| JBT2148 | | F | Ac-GYASFPWFVRLHVHKRSWEMA-NH2 | 2100 |
| JBT2149 | | F | Ac-GYASFPWFVQRHVHKRSWEMA-NH2 | 2101 |
| JBT2150 | | G | Ac-GYASFPWFVQLRVHKRSWEMA-NH2 | 2248 |
| JBT2151 | | F | Ac-GYASFPWFVQLHRHKRSWEMA-NH2 | 2102 |
| JBT2152 | | F | Ac-GYASFPWFVQLHVRKRSWEMA-NH2 | 2103 |

FIGURE 36N

| Object ID | IC50 [nM] | Affinity Class | Sequence | SEQ ID NO: |
|---|---|---|---|---|
| JBT2153 | | F | Ac-GYASFPWFVQLHVHRRSWEMA-NH2 | 2104 |
| JBT2154 | | F | Ac-GYASFPWFVQLHVHKRRWEMA-NH2 | 2105 |
| JBT2155 | | F | Ac-GYASFPWFVQLHVHKRSREMA-NH2 | 2106 |
| JBT2156 | | F | Ac-GYASFPWFVQLHVHKRSWRMA-NH2 | 2107 |
| JBT2157 | | G | Ac-GYASFPWFVQLHVHKRSWERA-NH2 | 2249 |
| JBT2158 | | F | Ac-GYASFPWFVQLHVHKRSWEMR-NH2 | 2108 |
| JBT2159 | | F | Ac-SYASFPWFVQLHVHKRSWEMA-NH2 | 2109 |
| JBT2160 | | G | Ac-GSASFPWFVQLHVHKRSWEMA-NH2 | 2250 |
| JBT2161 | | F | Ac-GYSSFPWFVQLHVHKRSWEMA-NH2 | 2110 |
| JBT2162 | | G | Ac-GYASSPWFVQLHVHKRSWEMA-NH2 | 2251 |
| JBT2163 | | | Ac-GYASFSWFVQLHVHKRSWEMA-NH2 | 2466 |
| JBT2164 | | G | Ac-GYASFPSFVQLHVHKRSWEMA-NH2 | 2252 |
| JBT2165 | | G | Ac-GYASFPWSVQLHVHKRSWEMA-NH2 | 2253 |
| JBT2166 | | G | Ac-GYASFPWFSQLHVHKRSWEMA-NH2 | 2254 |
| JBT2167 | | F | Ac-GYASFPWFVSLHVHKRSWEMA-NH2 | 2111 |
| JBT2168 | | G | Ac-GYASFPWFVQSHVHKRSWEMA-NH2 | 2255 |
| JBT2169 | | | Ac-GYASFPWFVQLSVHKRSWEMA-NH2 | 2467 |
| JBT2170 | | G | Ac-GYASFPWFVQLHSHKRSWEMA-NH2 | 2256 |
| JBT2171 | | G | Ac-GYASFPWFVQLHVSKRSWEMA-NH2 | 2257 |
| JBT2172 | | | Ac-GYASFPWFVQLHVHSRSWEMA-NH2 | 2468 |
| JBT2173 | | | Ac-GYASFPWFVQLHVHKSSWEMA-NH2 | 2469 |
| JBT2174 | | | Ac-GYASFPWFVQLHVHKRSSEMA-NH2 | 2470 |
| JBT2175 | | | Ac-GYASFPWFVQLHVHKRSWSMA-NH2 | 2471 |
| JBT2176 | | | Ac-GYASFPWFVQLHVHKRSWESA-NH2 | 2472 |
| JBT2177 | | | Ac-GYASFPWFVQLHVHKRSWEMS-NH2 | 2473 |
| JBT2178 | | F | Ac-TYASFPWFVQLHVHKRSWEMA-NH2 | 2112 |
| JBT2179 | | G | Ac-GTASFPWFVQLHVHKRSWEMA-NH2 | 2258 |
| JBT2180 | | F | Ac-GYTSFPWFVQLHVHKRSWEMA-NH2 | 2113 |
| JBT2181 | | F | Ac-GYATFPWFVQLHVHKRSWEMA-NH2 | 2114 |
| JBT2182 | | G | Ac-GYASTPWFVQLHVHKRSWEMA-NH2 | 2259 |

FIGURE 36O

| Object ID | IC50 [nM] | Affinity Class | Sequence | SEQ ID NO: |
|---|---|---|---|---|
| JBT2183 | | | Ac-GYASFTWFVQLHVHKRSWEMA-NH2 | 2474 |
| JBT2184 | | G | Ac-GYASFPTFVQLHVHKRSWEMA-NH2 | 2260 |
| JBT2185 | | G | Ac-GYASFPWTVQLHVHKRSWEMA-NH2 | 2261 |
| JBT2186 | | G | Ac-GYASFPWFTQLHVHKRSWEMA-NH2 | 2262 |
| JBT2187 | | G | Ac-GYASFPWFVTLHVHKRSWEMA-NH2 | 2263 |
| JBT2188 | | G | Ac-GYASFPWFVQTHVHKRSWEMA-NH2 | 2264 |
| JBT2189 | | | Ac-GYASFPWFVQLTVHKRSWEMA-NH2 | 2475 |
| JBT2190 | | | Ac-GYASFPWFVQLHTHKRSWEMA-NH2 | 2476 |
| JBT2191 | | G | Ac-GYASFPWFVQLHVTKRSWEMA-NH2 | 2265 |
| JBT2192 | | | Ac-GYASFPWFVQLHVHTRSWEMA-NH2 | 2477 |
| JBT2193 | | | Ac-GYASFPWFVQLHVHKTSWEMA-NH2 | 2478 |
| JBT2194 | | F | Ac-GYASFPWFVQLHVHKRTWEMA-NH2 | 2115 |
| JBT2195 | | | Ac-GYASFPWFVQLHVHKRSTEMA-NH2 | 2479 |
| JBT2196 | | | Ac-GYASFPWFVQLHVHKRSWTMA-NH2 | 2480 |
| JBT2197 | | | Ac-GYASFPWFVQLHVHKRSWETA-NH2 | 2481 |
| JBT2198 | | G | Ac-GYASFPWFVQLHVHKRSWEMT-NH2 | 2266 |
| JBT2199 | | | Ac-VYASFPWFVQLHVHKRSWEMA-NH2 | 2482 |
| JBT2200 | | | Ac-GVASFPWFVQLHVHKRSWEMA-NH2 | 2483 |
| JBT2201 | | | Ac-GYVSFPWFVQLHVHKRSWEMA-NH2 | 2484 |
| JBT2202 | | G | Ac-GYAVFPWFVQLHVHKRSWEMA-NH2 | 2267 |
| JBT2203 | | G | Ac-GYASVPWFVQLHVHKRSWEMA-NH2 | 2268 |
| JBT2204 | | | Ac-GYASFVWFVQLHVHKRSWEMA-NH2 | 2485 |
| JBT2205 | | | Ac-GYASFPVFVQLHVHKRSWEMA-NH2 | 2486 |
| JBT2206 | | F | Ac-GYASFPWVVQLHVHKRSWEMA-NH2 | 2116 |
| JBT2207 | | G | Ac-GYASFPWFVVLHVHKRSWEMA-NH2 | 2269 |
| JBT2208 | | F | Ac-GYASFPWFVQVHVHKRSWEMA-NH2 | 2117 |
| JBT2209 | | | Ac-GYASFPWFVQLVVHKRSWEMA-NH2 | 2487 |
| JBT2210 | | G | Ac-GYASFPWFVQLHVVKRSWEMA-NH2 | 2270 |
| JBT2211 | | | Ac-GYASFPWFVQLHVHVRSWEMA-NH2 | 2488 |
| JBT2212 | | | Ac-GYASFPWFVQLHVHKVSWEMA-NH2 | 2489 |

FIGURE 36P

| Object ID | IC50 [nM] | Affinity Class | Sequence | SEQ ID NO: |
|---|---|---|---|---|
| JBT2213 | | F | Ac-GYASFPWFVQLHVHKRVWEMA-NH2 | 2118 |
| JBT2214 | | G | Ac-GYASFPWFVQLHVHKRSVEMA-NH2 | 2271 |
| JBT2215 | | G | Ac-GYASFPWFVQLHVHKRSWVMA-NH2 | 2272 |
| JBT2216 | | G | Ac-GYASFPWFVQLHVHKRSWEVA-NH2 | 2273 |
| JBT2217 | | F | Ac-GYASFPWFVQLHVHKRSWEMV-NH2 | 2119 |
| JBT2218 | | G | Ac-WYASFPWFVQLHVHKRSWEMA-NH2 | 2274 |
| JBT2219 | | F | Ac-GWASFPWFVQLHVHKRSWEMA-NH2 | 2120 |
| JBT2220 | | F | Ac-GYWSFPWFVQLHVHKRSWEMA-NH2 | 2121 |
| JBT2221 | | G | Ac-GYAWFPWFVQLHVHKRSWEMA-NH2 | 2275 |
| JBT2222 | | F | Ac-GYASWPWFVQLHVHKRSWEMA-NH2 | 2122 |
| JBT2223 | | | Ac-GYASFWWFVQLHVHKRSWEMA-NH2 | 2490 |
| JBT2224 | | F | Ac-GYASFPWWVQLHVHKRSWEMA-NH2 | 2123 |
| JBT2225 | | G | Ac-GYASFPWFWQLHVHKRSWEMA-NH2 | 2276 |
| JBT2226 | | G | Ac-GYASFPWFVWLHVHKRSWEMA-NH2 | 2277 |
| JBT2227 | | F | Ac-GYASFPWFVQWHVHKRSWEMA-NH2 | 2124 |
| JBT2228 | | | Ac-GYASFPWFVQLWVHKRSWEMA-NH2 | 2491 |
| JBT2229 | | G | Ac-GYASFPWFVQLHWHKRSWEMA-NH2 | 2278 |
| JBT2230 | | G | Ac-GYASFPWFVQLHVWKRSWEMA-NH2 | 2279 |
| JBT2231 | | | Ac-GYASFPWFVQLHVHWRSWEMA-NH2 | 2492 |
| JBT2232 | | | Ac-GYASFPWFVQLHVHKWSWEMA-NH2 | 2493 |
| JBT2233 | | G | Ac-GYASFPWFVQLHVHKRWWEMA-NH2 | 2280 |
| JBT2234 | | G | Ac-GYASFPWFVQLHVHKRSWWMA-NH2 | 2281 |
| JBT2235 | | G | Ac-GYASFPWFVQLHVHKRSWEWA-NH2 | 2282 |
| JBT2236 | | F | Ac-GYASFPWFVQLHVHKRSWEMW-NH2 | 2125 |
| JBT2238 | | G | Ac-GYYSFPWFVQLHVHKRSWEMA-NH2 | 2283 |
| JBT2239 | | G | Ac-GYAYFPWFVQLHVHKRSWEMA-NH2 | 2284 |
| JBT2240 | | G | Ac-GYASYPWFVQLHVHKRSWEMA-NH2 | 2285 |
| JBT2241 | | | Ac-GYASFYWFVQLHVHKRSWEMA-NH2 | 2494 |
| JBT2242 | | G | Ac-GYASFPYFVQLHVHKRSWEMA-NH2 | 2286 |
| JBT2243 | | F | Ac-GYASFPWYVQLHVHKRSWEMA-NH2 | 2126 |

FIGURE 36Q

| Object ID | IC50 [nM] | Affinity Class | Sequence | SEQ ID NO: |
|---|---|---|---|---|
| JBT2244 | | G | Ac-GYASFPWFYQLHVHKRSWEMA-NH2 | 2287 |
| JBT2245 | | G | Ac-GYASFPWFVYLHVHKRSWEMA-NH2 | 2288 |
| JBT2246 | | G | Ac-GYASFPWFVQYHVHKRSWEMA-NH2 | 2289 |
| JBT2247 | | | Ac-GYASFPWFVQLYVHKRSWEMA-NH2 | 2495 |
| JBT2248 | | G | Ac-GYASFPWFVQLHYHKRSWEMA-NH2 | 2290 |
| JBT2249 | | G | Ac-GYASFPWFVQLHVYKRSWEMA-NH2 | 2291 |
| JBT2250 | | | Ac-GYASFPWFVQLHVHYRSWEMA-NH2 | 2496 |
| JBT2251 | | | Ac-GYASFPWFVQLHVHKYSWEMA-NH2 | 2497 |
| JBT2252 | | G | Ac-GYASFPWFVQLHVHKRYWEMA-NH2 | 2292 |
| JBT2253 | | G | Ac-GYASFPWFVQLHVHKRSYEMA-NH2 | 2293 |
| JBT2254 | | G | Ac-GYASFPWFVQLHVHKRSWYMA-NH2 | 2294 |
| JBT2255 | | G | Ac-GYASFPWFVQLHVHKRSWEYA-NH2 | 2295 |
| JBT2256 | | G | Ac-GYASFPWFVQLHVHKRSWEMY-NH2 | 2296 |

FIGURE 37

| Object ID | EC50 [nM] | | Sequence | SEQ ID NO: |
|---|---|---|---|---|
| JBT0126 | 55.6868 | | Biotinyl-Ttds-SGYASFPLAVQLHVSKRSKEMALARLYYKTS-NH2 | 2498 |

FIGURE 38A

| Object ID | IC50 Mean (nM] | Affinity Class | Sequence | SEQ ID NO: |
|---|---|---|---|---|
| JBT0049 | ND | | Ac-SGNTFVDERLLYFLTIGNMGMYAAQLKFRTS-NH2 | 3025 |
| JBT0050 | 2745 | E | Ac-SGRGCTKVIVFTFRHNKLIGYERRYNCTS-NH2 | 3047 |
| JBT0101 | 251 | D | Ac-KKSGVWQTHPRYFWTMWPDIKGEVIVLFGTSKK-NH2 | 3036 |
| JBT0129 | ND | | Ac-SGRG[CTKVIVFTFRHNKLIGYERRYNC]TS-NH2 | 3026 |
| JBT0176* | 39444 | G | Ac-KKVGSVTRWSMYGPIFIKFTWTLEQPVGWDHKK-NH2 | 3056 |
| JBT0177* | >50000 | | Ac-KKLTGDWTYFWSKVIWGPGVIERQMPVSTFHKK-NH2 | 3065 |
| JBT0178 | 72 | B | Ac-KKSGVWQTHPRYFWTMWPDIKGEVIVLFGTKK-NH2 | 3028 |
| JBT0179 | >50000 | | Ac-KKSGVWQTHPRYFWTMWPDIKGEVIVLKK-NH2 | 3066 |
| JBT0180 | >50000 | | Ac-KKSGVWQTHPRYFWTMWPDIKGEVKK-NH2 | 3067 |
| JBT0181 | >50000 | | Ac-KKSGVWQTHPRYFWTMWPDIKKK-NH2 | 3068 |
| JBT0182 | 351 | D | Ac-KKGVWQTHPRYFWTMWPDIKGEVIVLFGTSKK-NH2 | 3037 |
| JBT0183 | >50000 | | Ac-KKQTHPRYFWTMWPDIKGEVIVLFGTSKK-NH2 | 3069 |
| JBT0184 | >50000 | | Ac-KKPRYFWTMWPDIKGEVIVLFGTSKK-NH2 | 3070 |
| JBT0185 | 45487 | G | Ac-KKFWTMWPDIKGEVIVLFGTSKK-NH2 | 3057 |
| JBT0186 | >50000 | | Ac-KKSGVWQTHPRYFWTMWPDIKGKK-NH2 | 3071 |
| JBT0187 | >50000 | | Ac-KKWQTHPRYFWTMWPDIKGEVIKK-NH2 | 3072 |
| JBT0188 | 25532 | G | Ac-KKHPRYFWTMWPDIKGEVIVLFKK-NH2 | 3058 |
| JBT0189 | 35115 | G | Ac-KKYFWTMWPDIKGEVIVLFGTSKK-NH2 | 3059 |
| JBT0190 | 100 | C | Ac-KKSGNTFVDERLLYFLTIGNMGMYAAQLKFRTSKK-NH2 | 3031 |
| JBT0191* | 8935 | F | Ac-MLGVLMRGISALTGDYTARFEFYLNKQTFN-NH2 | 3054 |
| JBT0193 | >50000 | | Ac-KKSGNTFVDERLLYFLTIGNMGMYAAQLKFKK-NH2 | 3073 |
| JBT0194 | >50000 | | Ac-KKSGNTFVDERLLYFLTIGNMGMYAAQKK-NH2 | 3074 |
| JBT0195 | >50000 | | Ac-KKSGNTFVDERLLYFLTIGNMGMYKK-NH2 | 3075 |
| JBT0196 | 3457 | E | Ac-KKSGNTFVDERLLYFLTIGNMKK-NH2 | 3048 |
| JBT0197 | >50000 | | Ac-KKTFVDERLLYFLTIGNMGMYAAQLKFRTSKK-NH2 | 3076 |
| JBT0198 | >50000 | | Ac-KKDERLLYFLTIGNMGMYAAQLKFRTSKK-NH2 | 3077 |
| JBT0199 | >50000 | | Ac-KKLLYFLTIGNMGMYAAQLKFRTSKK-NH2 | 3078 |
| JBT0200 | >50000 | | Ac-KKFLTIGNMGMYAAQLKFRTSKK-NH2 | 3079 |
| JBT0201 | >50000 | | Ac-KKLLYFLTIGNMGMYAAQLKFRKK-NH2 | 3080 |
| JBT0202 | >50000 | | Ac-KKLYFLTIGNMGMYAAQLKFRTKK-NH2 | 3081 |
| JBT0203 | >50000 | | Ac-KKYFLTIGNMGMYAAQLKFRTSKK-NH2 | 3082 |

FIGURE 38B

| Object ID | IC50 Mean (nM] | Affinity Class | Sequence | SEQ ID NO: |
|---|---|---|---|---|
| JBT0204 | 25693 | G | Ac-KKSGNTFVDERLLYFLTIGNMGKK-NH2 | 3060 |
| JBT0205 | 72 | B | Ac-KKSGRGCTKVIVFTFRHNKLIGYERRYNCTSKK-NH2 | 3029 |
| JBT0206* | 3594 | E | Ac-TNYTGSEKCIRFVTRRYLGVRINCFHKGS-NH2 | 3049 |
| JBT0207* | 4316 | E | Ac-TRNVVRRYECFGSTGCIKYFIHSRTGLNK-NH2 | 3050 |
| JBT0208 | ND | | Ac-KKSGRGCTKVIVFTFRHNKLIGYERRYNKK-NH2 | 3027 |
| JBT0209 | 4756 | E | Ac-KKSGRGCTKVIVFTFRHNKLIGYERKK-NH2 | 3051 |
| JBT0210 | 20471 | G | Ac-KKSGRGCTKVIVFTFRHNKLIGKK-NH2 | 3061 |
| JBT0211 | 211 | C | Ac-KKGCTKVIVFTFRHNKLIGYERRYNCTSKK-NH2 | 3032 |
| JBT0212 | 117 | C | Ac-KKKVIVFTFRHNKLIGYERRYNCTSKK-NH2 | 3033 |
| JBT0213 | >50000 | | Ac-KKVFTFRHNKLIGYERRYNCTSKK-NH2 | 3083 |
| JBT0214 | 2277 | E | Ac-KKGRGCTKVIVFTFRHNKLIGYKK-NH2 | 3052 |
| JBT0215 | 6146 | F | Ac-KKGCTKVIVFTFRHNKLIGYERKK-NH2 | 3055 |
| JBT0216 | 2123 | E | Ac-KKCTKVIVFTFRHNKLIGYERRKK-NH2 | 3053 |
| JBT0217 | 47024 | G | Ac-KKTKVIVFTFRHNKLIGYERRYKK-NH2 | 3062 |
| JBT0218 | 32865 | G | Ac-KKKVIVFTFRHNKLIGYERRYNKK-NH2 | 3063 |
| JBT0219 | 78 | B | Ac-KKVIVFTFRHNKLIGYERRYNCKK-NH2 | 3030 |
| JBT0220 | 31914 | G | Ac-KKIVFTFRHNKLIGYERRYNCTKK-NH2 | 3064 |
| JBT0344 | 629 | D | Ac-TFVDERLLYFLTIGNMGMYAAQLKF-NH2 | 3038 |
| JBT0345 | 271 | D | Ac-FVDERLLYFLTIGNMGMYAAQLKF-NH2 | 3039 |
| JBT0346 | 214 | C | Ac-VDERLLYFLTIGNMGMYAAQLKF-NH2 | 3034 |
| JBT0347 | 434 | D | Ac-TFVDERLLYFLTIGNMGMYAAQLK-NH2 | 3040 |
| JBT0348 | >5000 | | Ac-TFVDERLLYFLTIGNMGMYAAQ-NH2 | 3084 |
| JBT0349 | 552 | D | Ac-GCTKVIVFTFRHNKLIGYERRYNCTS-NH2 | 3041 |
| JBT0350 | 527 | D | Ac-CTKVIVFTFRHNKLIGYERRYNCTS-NH2 | 3042 |
| JBT0351 | 948 | D | Ac-TKVIVFTFRHNKLIGYERRYNCTS-NH2 | 3043 |
| JBT0352 | 848 | D | Ac-GCTKVIVFTFRHNKLIGYERRYNCT-NH2 | 3044 |
| JBT0353 | 668 | D | Ac-GCTKVIVFTFRHNKLIGYERRYNC-NH2 | 3045 |
| JBT0357 | 125 | C | Ac-KKGVWQTHPRYFWTMWPDIKGEVIVLFGKK-NH2 | 3035 |
| JBT0358 | 802 | D | Ac-KKGVWQTHPRYFWTMWPDIKGEVIVLFKK-NH2 | 3046 |

FIGURE 39

| Object ID | EC50 [nM] | Object Name | SEQ ID NO: |
|---|---|---|---|
| JBT0052 | 2.8 | Biotinyl-Ttds-KKSGVWQTHPRYFWTMWPDIKGEVIVLFGTSKK-NH2 | 3004 |
| JBT0053 | 50.3 | Biotinyl-Ttds-SGNTFVDERLLYFLTIGNMGMYAAQLKFRTS-NH2 | 3006 |
| JBT0054 | 2.1 | Biotinyl-Ttds-SGRGCTKVIVFTFRHNKLIGYERRYNCTS-NH2 | 3002 |
| JBT0057 | >5000 | Ac-SGNTFVDERLLYFLTIGNMGMYAAQLKFRTS-Ttds-Lysin(biotin)-NH2 | 3018 |
| JBT0058 | 2.4 | Ac-SGRGCTKVIVFTFRHNKLIGYERRYNCTS-Ttds-Lysin(biotin)-NH2 | 3003 |
| JBT0103 | 4.8 | Ac-KKSGVWQTHPRYFWTMWPDIKGEVIVLFGTS-Ttds-KK-Lysin(biotin)-NH2 | 3005 |
| JBT0105 | >10000 | Biotinyl-Ttds-SGQFWHGLLLPKGIVLNWTLKPWWMIGAFTS-NH2 | 3015 |
| JBT0106 | >10000 | Ac-SGQFWHGLLLPKGIVLNWTLKPWWMIGAFTS-Ttds-Lysin(biotin)-NH2 | 3016 |
| JBT0113 | 458.7 | Biotinyl-Ttds-LSLVGSFAVLCA-NH2 | 3007 |
| JBT0117 | >50000 | Biotinyl-Ttds-SGRFTTRLWYFSWDRLPWYMPFKQYVLSSTS-NH2 | 3019 |
| JBT0118 | >50000 | Biotinyl-Ttds-SGSYQWWARPYRMWFGLPYWNQRVIFPWNTS-NH2 | 3020 |
| JBT0128 | >5000 | Ac-Ttds-SGRVSYYWGVKWSQQMPMSWWPDTWYTFDTS-NH2 | 3017 |
| JBT0130 | 1.2 | Biotinyl-Ttds-SGRG[CTKVIVFTFRHNKLIGYERRYNC]TS-NH2 | 3001 |
| JBT0135 | >50000 | Biotinyl-Ttds-LLYFLTIGNMGMYAAQLKFR-NH2 | 3021 |
| JBT0136 | 16461.9 | Biotinyl-Ttds-LYFLTIGNMGMYAAQLKFRT-NH2 | 3014 |
| JBT0137 | 4120.3 | Biotinyl-Ttds-YFLTIGNMGMYAAQLKFRTS-NH2 | 3013 |
| JBT0138 | 2354.6 | Biotinyl-Ttds-YFLTIGNMGMYAAQLKFR-NH2 | 3012 |
| JBT0139 | 755.5 | Biotinyl-Ttds-GRGCTKVIVFTFRHNKLIGY-NH2 | 3008 |
| JBT0140 | 924.0 | Biotin-Ttds-GCTKVIVFTFRHNKLIGYER-NH2 | 3010 |
| JBT0141 | 800.3 | Biotin-Ttds-CTKVIVFTFRHNKLIGYERR-NH2 | 3009 |
| JBT0142 | >50000 | Biotinyl-Ttds-TKVIVFTFRHNKLIGYERRY-NH2 | 3022 |
| JBT0143 | 4229.9 | Biotinyl-Ttds-KVIVFTFRHNKLIGYERRYN-NH2 | 3023 |
| JBT0144 | 1327.0 | Biotin-Ttds-VIVFTFRHNKLIGYERRYNC-NH2 | 3011 |
| JBT0145 | 650.9 | Biotin-Ttds-VIVFTFRHNKLIGYER-NH2 | 3024 |

TFPI INHIBITORS AND METHODS OF USE

CROSS REFERENCE TO RELATED APPLICATIONS AND INCORPORATION BY REFERENCE

This application claims priority to U.S. Provisional Patent Application No. 61/139,272, filed Dec. 19, 2008, the disclosure of which is incorporated by reference in its entirety.

TECHNICAL FIELD OF THE INVENTION

The invention generally relates to peptides that bind Tissue Factor Pathway Inhibitor (TFPI) and uses thereof.

BACKGROUND OF THE INVENTION

Hemostasis relies on the complex coagulation cascade, wherein a series of events mediated by blood clotting factors lead to conversion of prothrombin to thrombin. Factor X (FX) activation is the central event of both the intrinsic and extrinsic pathways of the coagulation cascade. The extrinsic pathway has been proposed as the primary activator of the coagulation cascade (Mackman et al., *Arterioscler. Thromb. Case. Biol.,* 27, 1687-1693 (2007)). Circulating Tissue Factor (TF) and activated Factor VII (FVIIa) interact to form the "extrinsic complex," which mediates activation of FX. The coagulation cascade is amplified by the intrinsic pathway, during which successive activation of factors XII, XI, IX, and VIII results in formation of the "intrinsic" FIXa-FVIIIa complex that also mediates FX activation. Activated FX promotes thrombin formation, which is required for the body to create fibrin and effectively curb bleeding.

Severe bleeding disorders, such as hemophilia, result from disruption of the blood coagulation cascade. Hemophilia A, the most common type of hemophilia, stems from a deficiency in factor VIII, while hemophilia B is associated with deficiencies in Factor IX (FIX). Hemophilia C is caused by a deficiency in Factor XI (FXI) (Cawthern et al., *Blood,* 91(12), 4581-4592 (1998)). There is currently no cure for hemophilia and other clotting diseases. Factor replacement therapy is the most common treatment for blood coagulation disorders. However, blood clotting factors typically are cleared from the bloodstream shortly after administration. To be effective, a patient must receive frequent intravenous infusions of plasma-derived or recombinant factor concentrates, which is uncomfortable, requires clinical settings, is expensive, and is time consuming. In addition, therapeutic efficacy of factor replacement therapy can diminish drastically upon formation of inhibitory antibodies. Approximately 30% of patients with severe hemophilia A develop inhibitory antibodies that neutralize Factor VIII (FVIII) (Peerlinck and Hermans, *Haemophilia,* 12, 579-590 (2006)). Few therapeutic options exist for patients with anti-Factor antibodies.

Thus, there exists a need in the art for compositions and methods for treating blood coagulation disorders. The invention provides such compositions and methods.

SUMMARY OF THE INVENTION

The invention provides peptides that bind to Tissue Factor Pathway Inhibitor (TFPI), including TFPI antagonistic peptides having the ability to modulate the blood coagulation cascade. For example, the invention provides a peptide comprising the amino acid sequence $X_7X_8X_9X_{10}X_{11}X_{12}X_{13}X_{14}X_{15}X_{16}X_{17}X_{18}X_{19}X_{20}X_{21}$ (SEQ ID NO: 3109), wherein $X_7$ is selected from the group consisting of L, P, K, S, W, V, N, and Q;

$X_8$ is selected from the group consisting of L, R, N, F, and I;

$X_9$ is selected from the group consisting of Y, V, P, and C;

$X_{10}$ is selected from the group consisting of F, L, and G;

$X_{11}$ is selected from the group consisting of L, W, V, A, M, T, and S;

$X_{12}$ is selected from the group consisting of T, F, V, R, A, D, L, E, S, and Y;

$X_{13}$ is selected from the group consisting of I, M, G, Q, D, and R;

$X_{14}$ is selected from the group consisting of G, W, Y, L, M, and H;

$X_{15}$ is selected from the group consisting of N, P, F, H, K, and Y;

$X_{16}$ is selected from the group consisting of M, D, E, V, G, and K;

$X_{17}$ is selected from the group consisting of G, I, R, S, T, and L;

$X_{18}$ is selected from the group consisting of M, K, L, and I;

$X_{19}$ is selected from the group consisting of Y, G, R, and S;

$X_{20}$ is selected from the group consisting of A, E, S, C, and Y; and $X_{21}$ is selected from the group consisting of A, V, K, and E.

In one aspect, the peptide comprises one or more N-terminal amino acid(s) directly linked to $X_7$, wherein the N-terminal amino acid(s) comprise the amino acid sequence selected from the group consisting of

| | |
|---|---|
| $X_6$, | |
| $X_5X_6$, | |
| $X_4X_5X_6$, | |
| $X_3X_4X_5X_6$ | (SEQ ID NO: 3110), |
| $X_2X_3X_4X_5X_6$ and | (SEQ ID NO: 3111), |
| $X_1X_2X_3X_4X_5X_6$ | (SEQ ID NO: 3112), |

wherein $X_1$ is selected from the group consisting of T and G; $X_2$ is selected from the group consisting of F and V; $X_3$ is selected from the group consisting of V, W, Y, and F; $X_4$ is selected from the group consisting of D, Q, and S; $X_5$ is selected from the group consisting of E, T, N, and S; and $X_6$ is selected from the group consisting of R, H, K, and A.

Alternatively or in addition, the peptide comprises one or more C-terminal amino acids directly linked to $X_{21}$, wherein the C-terminal amino acid(s) comprise the amino acid sequence selected from the group consisting of

| | |
|---|---|
| $X_{22}$, | |
| $X_{22}X_{23}$, | |
| $X_{22}X_{23}X_{24}$, | |
| $X_{22}X_{23}X_{24}X_{25}$ | (SEQ ID NO: 3113), |
| $X_{22}X_{23}X_{24}X_{25}X_{26}$ and | (SEQ ID NO: 3114), |
| $X_{22}X_{23}X_{24}X_{25}X_{26}X_{27}$ | (SEQ ID NO: 3115), |

wherein $X_{22}$ is selected from the group consisting of Q, I, E, W, R, L, and N; $X_{23}$ is selected from the group consisting of L, V, M, and R; $X_{24}$ is selected from the group consisting of K, L, A, and Y; $X_{25}$ is F; $X_{26}$ is G; and $X_{27}$ is T.

In one aspect, the invention provides a peptide comprising the amino acid sequence set forth in SEQ ID NOs: 1-7, such as a peptide comprising the amino acid sequence set forth in any one of JBT0132, JBT0303, JBT0193, JBT0178, JBT0120, and JBT0224, which inhibits TFPI activity within the blood coagulation cascade. The invention also provides a peptide that binds TFPI comprising an amino acid sequence of at least 60% identity to the sequence Phe-Gln-Ser-Lys-Gly-Asn-Val-Phe-Val-Asp-Gly-Tyr-Phe-Glu-Arg-Leu-Arg-Ala-Lys-Leu (FQSKGNVFVDGYFERLRAKL) (SEQ ID NO: 32).

In addition, the invention provides a peptide that binds TFPI, wherein the peptide comprises the structure of formula (I): X1001-X1002-X1003-X1004-X1005-X1006-X1007-X1008-X1009-X1010-X1011-X1012-X1013-X1014-X1015-X1016-X1017-X1018-X1019-X1020 (SEQ ID NO: 3116). In formula (I), X1001 is an amino acid selected from the group consisting of Bhf, C, D, F, G, H, I, K, L, M, N, Nmf, Q, R, T, V, W and Y;

X1002 is an amino acid selected from the group consisting of G, K and Q;

X1003 is an amino acid selected from the group consisting of A, Aib, Bhs, C, D, E, F, G, H, I, K, L, M, N, P, Q, R, S, T, V, W and Y;

X1004 is an amino acid selected from the group consisting of A, Aib, Bhk, C, D, E, F, G, H, I, K, k, L, M, N, Nmk, P, Q, R, S, T, V, W and Y;

X1005 is an amino acid selected from the group consisting of a, A, Aib, Bal, C, D, d, E, F, G, H, K, k, L, M, N, Nmg, p, Q, R, S, T, V, W and Y;

X1006 is an amino acid selected from the group consisting of A, Aib, Btq, C, D, E, F, G, H, I, K, L, M, N, Q, R, S T, V, W and Y;

X1007 is an amino acid selected from the group consisting of A, F, G, I, K, L, Nmv, P, Q, S, V, W and Y;

X1008 is an amino acid selected from the group consisting of F, H, K, W and Y;

X1009 is an amino acid selected from the group consisting of A, Aib, f, I, K, S, T and V;

X1010 is an amino acid selected from the group consisting of A, Aib, C, D, E, F, G, H, I, K, L, M, N, Nmf, P, Q, R, S, T, V, W and Y;

X1011 is an amino acid selected from the group consisting of Aib, C, K, G and Nmg;

X1012 is Y;

X1013 is an amino acid selected from the group consisting of A, Aib, C, E, F, G, H, K, L, M, Q, R, W and Y;

X1014 is an amino acid selected from the group consisting of A, Aib, Bhe, C, D, E, F, G, H, I, K, L, M, N, P, Q, R, S, T, V, W and Y;

X1015 is an amino acid selected from the group consisting of (omega-methyl)-R, D, E, K and R;

X1016 is L;

X1017 is an amino acid selected from the group consisting of (omega-methyl)-R, A, Aib, Bhr, C, Cha, Cit, D, Dab, Dap, E, Eag, Eew, F, G, H, Har, Hci, Hle, I, K, L, M, N, Nle, Nva, Opa, Orn, Q, R, S, T, V, W and Y;

X1018 is an amino acid selected from the group consisting of A, Bal, C, D, E, F, G, H, I, K, L, M, N, Q, R, S, T, V, W and Y;

X1019 is an amino acid selected from the group consisting of Bhk, K, R and V; and X1020 is either present or absent, whereby, in case X1020 is present, it is an amino acid selected from the group consisting of Aib, Bhl, C, F, G, H, I, K, L, Nml, Q, R, S, T, V, W and Y.

In one aspect, the peptide that binds TFPI comprises the structure of formula (III): X1001-Q-X1003-X1004-X1005-X1006-I/V-X1008-V-X1010-G-Y-C/F-X1014-R-L-X1017-X1018-K-K/L (III) (SEQ ID NO: 3117). In formula (III), X1001, X1003, X1004, X1005, X1006, X1008, X1010, X1014, X1017 and X1018 are each independently selected from any amino acid.

The invention further provides a TFPI-binding peptide comprising the structure of formula (V): X2001-X2002-X2003-X2004-X2005-X2006-[X2007-X2008-X2009-X2010-X2011-X2012-X2013-X2014-X2015-X2016-X2017-X2018]-X2019-X2020-X2021-X2022-X2023 (V) (SEQ ID NO: 3118). In formula (V), X2001, X2002, and X2023 independently are either present or absent. When present, X2001 is an amino acid selected from the group consisting of A, D, E, F, G, H, I, K, L, P, R, S, T, V and W; and X2002 is an amino acid selected from the group consisting of A, D, E, F, G, H, I, K, L, M, P, R, S, T, V and W. Additionally, X2003 is an amino acid selected from the group consisting of A, F, I, K, L, R, S, T, V, W and Y;

X2004 is an amino acid selected from the group consisting of A, D, E, F, G, I, K, L, R, S, T, V and W;

X2005 is W;

X2006 is an amino acid selected from the group consisting of F, H, I, K, L, R V and W;

X2007 is an amino acid selected from the group consisting of C, Hcy, Dap and K, preferably selected from the group consisting of C and Hcy;

X2008 is an amino acid selected from the group consisting of A, G, R, S and T;

X2009 is an amino acid selected from the group consisting of a, A, I, K, L, M, m, Nle, p, R, and V;

X2010 is an amino acid selected from the group consisting of A, G, I, K, L, P, R, S, T and V;

X2011 is an amino acid selected from the group consisting of D, E, G, S and T;

X2012 is an amino acid selected from the group consisting of A, a, D, d, E, e, F, f, G, I, K, k, L, l, M, m, Nle, nle, P, p, R, r, S, s, T, t, V, v, W and w;

X2013 is an amino acid selected from the group consisting of A, D, d, E, e, F, G, I, K, L, R, S, s, T, V and W;

X2014 is an amino acid selected from the group consisting of A, D, E, F, G, I, K, L, M, R, S, T, V and W;

X2015 is an amino acid selected from the group consisting of A, D, E, F, G, I, K, L, M, Nle, R, S, T, V and W;

X2016 is an amino acid selected from the group consisting of A, D, E, F, I, K, L, M, Nle, R, S, T, V, W and Y;

X2017 is an amino acid selected from the group consisting of A, D, E, F, G, I, K, L, R, S, T, V, W and Y;

X2018 is an amino acid selected from the group consisting of C and D (preferably X2018 is C);

X2019 is an amino acid selected from the group consisting of A, F, I, L, S, T, V and W;

X2020 is an amino acid selected from the group consisting of F and W;

X2021 is an amino acid selected from the group consisting of I, L and V; and

X2022 is an amino acid selected from the group consisting of A, D, E, F, G, I, K, L, P, R, S, T, V, and W.

When X2023 is present in the peptide, X2023 is an amino acid selected from the group consisting of A, D, E, F, G, I, K, L, R, S, T, V, W and Y. The peptide comprises a cyclic structure generated by a linkage between X2007 and X2018, indicated in Formula (V) by brackets.

The invention also provides a peptide that binds TFPI, wherein the peptide comprises the structure of formula (VI): X2001-X2002-F/Y-K-W-F/H-[C-X2008-M/V-X2010-D-X2012-X2013-G-I/T-X2016-S/T-C]-A/V-W-V-X2022-X2023 (VI) (SEQ ID NO: 3119). In formula (VI), X2001, X2002 and X2023 are each independently present or absent. X2008, X2010, X2012, X2013, X2016 and X2022, as well as X2001, X2002, and X2023 when present, are each independently selected from any amino acid. The peptide comprises a cyclic structure generated by a linkage between X2007 and X2018, indicated in Formula (VI) by brackets.

In one aspect, the invention provides a peptide that binds TFPI, wherein the peptide comprises the structure of formula (VIII): X3001-X3002-X3003-X3004-X3005-X3006-X3007-X3008-X3009-X3010-X3011-X3012-X3013-X3014-X3015-X3016-X3017-X3018-X3019-X3020-X3021 (VIII) (SEQ ID NO: 3120). In formula (VIII), X3001 and X3002 are each independently present or absent. When present, X3001 is an amino acid selected from the group consisting of A, C, D, F, G, I, K, L, M, N, P, Q, R, S, T, W, E, H and Y; and X3002 is an amino acid selected from the group consisting of A, C, D, F, H, K, M, N, P, R, S, T, W, Y, G, I and L. With respect to the remainder of formula (VIII), X3003 is an amino acid selected from the group consisting of A, C, D, E, F, G, H, I, K, L, M, N, P, Q, R, S, T, W and Y;

X3004 is an amino acid selected from the group consisting of A, C, D, E, F, G, H, I, K, L, M, N, Q, R, S, T, V, W, Y and P;

X3005 is an amino acid selected from the group consisting of C, D, F, G, H, I, K, L, M, N, P, R, S, T, V, W and Y;

X3006 is an amino acid selected from the group consisting of A, W, C, K, P, R and H;

X3007 is an amino acid selected from the group consisting of Q, A, C, F, G, H, I, K, L, N, R, S, T, W and Y;

X3008 is an amino acid selected from the group consisting of A, C, F, G, H, K, L, M, N, P, Q, R, S, T, V, W, Y and I;

X3009 is an amino acid selected from the group consisting of A, C, F, G, H, I, L, M, R, S, T, V, W, Y and K;

X3010 is an amino acid selected from the group consisting of A, C, F, G, H, I, K, L, M, N, P, Q, R, S, T, V, W and Y;

X3011 is an amino acid selected from the group consisting of A, G, I, K, L, M, N, Q, R, S, T, V, W, Y, C, F and H;

X3012 is an amino acid selected from the group consisting of A, C, H, I, K, L and R;

X3013 is an amino acid selected from the group consisting of A, C, F, G, H, K, L, M, R, S, V, W, Y and I;

X3014 is an amino acid selected from the group consisting of A, C, F, G, H, I, L, M, N, Q, R, S, T, V, W, Y and K;

X3015 is an amino acid selected from the group consisting of A, K and R;

X3016 is an amino acid selected from the group consisting of A, F, K and R;

X3017 is an amino acid selected from the group consisting of A, C, F, G, I, K, L, N, Q, R, S, T, V, W, Y, H, A and M;

X3018 is an amino acid selected from the group consisting of A, C, F, I, K, L, M, Q, R, V, W and Y;

X3019 is an amino acid selected from the group consisting of A, C, D, E, F, G, H, K, L, N, P, Q, R, V, W, Y and I;

X3020 is an amino acid selected from the group consisting of A, C, F, G, H, K, L, M, N, Q, R, V, W, Y, I and P; and X3021 is an amino acid selected from the group consisting of A, C, H, I, K, L, M, N, P, Q, R, T, V, W, Y, F and G.

Additionally, the invention provides a TFPI-binding peptide comprising the structure of formula (IX): X3001-X3002-X3003-X3004-X3005-X3006-X3007-X3008-X3009-X3010-X3011-H-X3013-X3014-K/R-R-X3017-X3018-X3019-X3020-X3021 (IX) (SEQ ID NO: 3121), wherein X3001, X3002, X3003, X3004, X3005, X3006, X3007, X3008, X3009, X3010, X3011, X3013, X3014, X3017, X3018, X3019, X3020 and X3021 are each independently selected from any amino acid. In addition, the invention includes a peptide that binds TFPI, wherein the peptide comprises an amino acid sequence having at least 60% identity to the sequence of formula (X): Ac-GYASFPWFVQLHVHKRSWEMA-NH2 (SEQ ID NO: 223). In the context of the disclosure, any peptide encompassed by any of formulas (I) to (X) and any TFPI-binding peptide described herein is also referred to as "the peptide of the invention" and as "a peptide as described herein."

In some embodiments, the peptide of the invention binds TFPI-1 (e.g., TFPI-1α) and, optionally, improves TFPI-regulated thrombin generation in the absence of FVIII, FIX, and/or FXI. A composition (e.g., a pharmaceutical composition) comprising the peptide also is provided.

In addition, the invention provides methods of using the peptide of the invention. For example, the invention provides a method of inhibiting a TFPI comprising contacting the TFPI with a peptide as described herein. The invention also provides a method of enhancing thrombin formation in a clotting factor-deficient subject, a method for increasing blood clot formation in a subject, and a method of treating a blood coagulation disorder in a subject. The methods are, in their entirety, also referred to herein as, e.g., "the method of the invention." The methods comprise administering to the subject a peptide as provided herein in an amount effective to enhance thrombin formation, an amount effective to enhance blood clot formation, or an amount effective to treat the blood coagulation disorder in the subject. Unless explicitly indicated to the contrary, the description provided herein with respect to one peptide of the invention or method of the invention applies to each and every peptide of the invention and method of the invention, respectively. Further aspects of the invention include use of the peptide of the invention for the manufacture of a medicament, a method for targeting a cell displaying TFPI, a method for treating or diagnosing a subject suffering from a disease or at risk of suffering from a disease, and a method of purifying TFPI. The preceding methods are, in their entirety, also referred to herein as, e.g., "the method of the invention."

DESCRIPTION OF THE FIGURES

FIG. 4 is a listing of amino acid sequences of various TFPI-inhibitory peptides denoting amino acid substitutions (bolded and underlined) in reference to peptide JBT0293.

FIGS. 12-18 are tables listing the amino acid sequences of various TFPI-inhibitory peptides; $EC_{50}$ and percent inhibition of TFPI observed in the FXa inhibition assay; $EC_{50}$ and percent inhibition of TFPI observed in the extrinsic tenase inhibition assay; and FEIBA, Factor VIII (FVIII) Immunate, or Factor IX (FIX) equivalent activities (mU/mL) in plasma-based assays. "*" denotes negative controls.

FIGS. 19-21 are tables listing the results from BIAcore analysis of several TFPI-binding peptides. "*" denotes negative controls.

FIGS. 22-30 are tables listing the amino acid sequences of various TFPI-binding peptides; $EC_{50}$ and percent inhibition of TFPI observed in the FXa inhibition assay; $EC_{50}$ and percent inhibition of TFPI observed in the extrinsic tenase inhibition assay; and FEIBA, FVIII Immunate, or FIX equivalent activities (mU/mL) in plasma-based assays. "*" denotes negative controls.

FIGS. 32-39 are tables listing the amino acid sequences and $IC_{50}$ or $EC_{50}$ values of various peptides of the invention. "*" denotes negative controls.

DETAILED DESCRIPTION OF THE INVENTION

Figure 1:
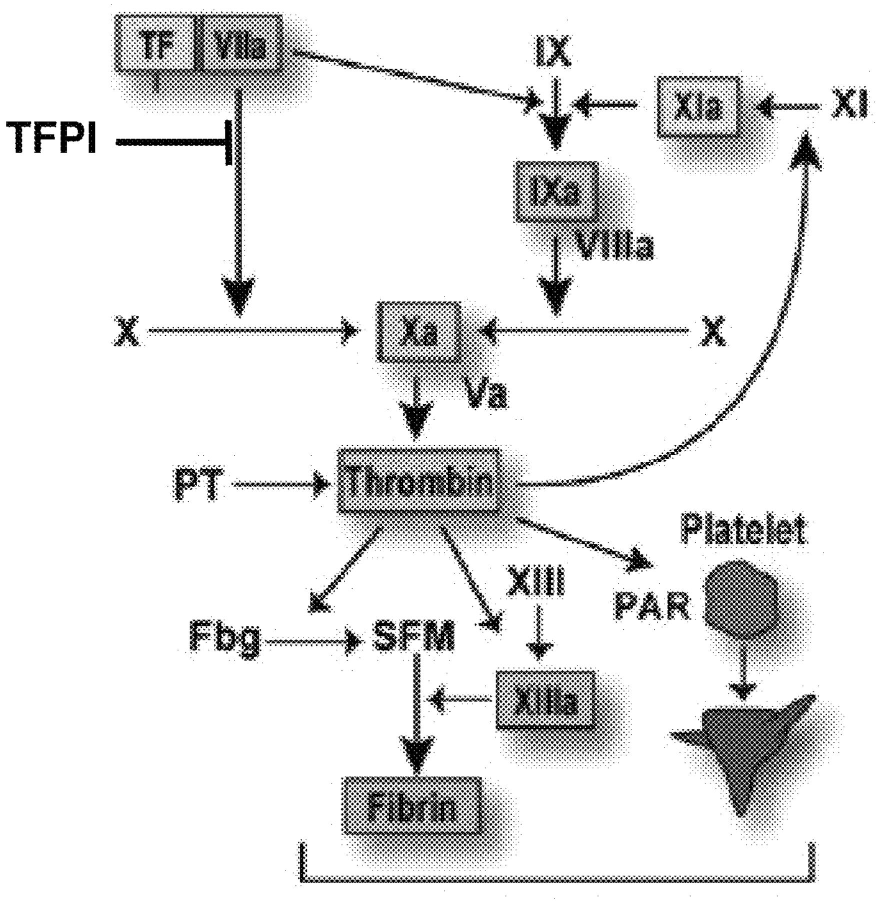
FIG. 1 is an illustration of the blood coagulation cascade.
Figure 2:
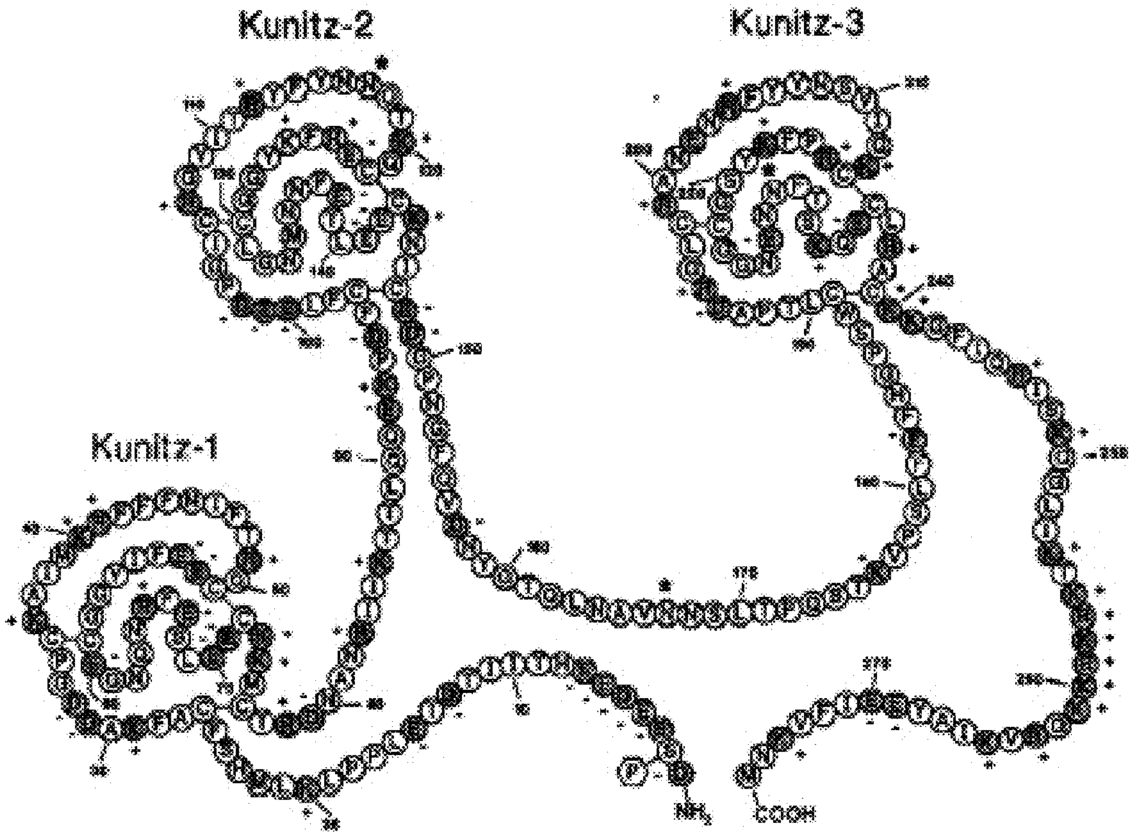
FIG. 2 is an illustration of the secondary structure of Tissue Factor Pathway Inhibitor-1.
Figure 3:
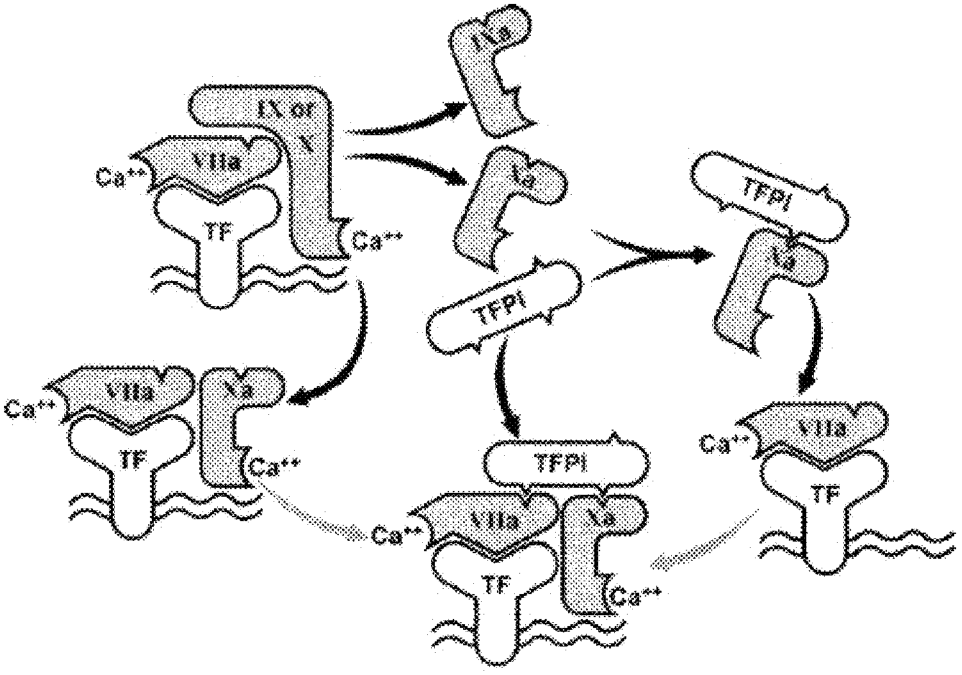
FIG. 3 is an illustration of the formation of a quaternary complex comprising Tissue Factor, Factor Xa (FXa), Factor VIIa (FVIIa), and TFPI.

The invention provides peptides that block the inhibitory activity of Tissue Factor Pathway Inhibitor-1 (herein referred to as TFPI) within the blood coagulation cascade. Upon vascular injury, Tissue Factor (TF) complexes with Factor VIIa to form the "extrinsic complex" or "extrinsic tenase complex," which activates Factors IX and X (FIG. 1). TFPI is the main natural regulator of TF/FVIIa extrinsic complex activity and by extension, plays a role in controlling thrombin generation (Panteleev et al., *Eur. J. Biochem.,* 249, 2016-2031 (2002)). TFPI is a 43 kDa serine protease inhibitor comprising three Kunitz-type inhibitory domains (FIG. 2). Kunitz domain 1 of TFPI binds FVIIa and Kunitz domain 2 binds FXa, enabling the inhibitor to form a quaternary FXa-TFPI-FVIIa-TF complex that blocks activity of the TF/FVIIa extrinsic complex (FIG. 3). TFPI binding of FXa also downregulates the common pathway of the coagulation cascade, during which FXa converts prothrombin to thrombin (Audu et al., *Anesth. Analg.,* 103(4), 841-845 (2006)). The invention provides, e.g., TFPI-inhibitory peptides that block TFPI's inhibitory action on the blood coagulation cascade, thereby enhancing thrombin formation.

The amino acid sequences of several TFPI-binding peptides are provided herein. Conventional amino acids are identified according to their standard, one-letter or three-letter codes, as set forth in Table 1.

TABLE 1

| 3-letter codes | 1-letter code | Amino acids |
|---|---|---|
| Ala | A | Alanine |
| Cys | C | Cysteine |
| Asp | D | Aspartic acid |
| Glu | E | Glutamic acid |
| Phe | F | Phenylalanine |
| Gly | G | Glycine |
| His | H | Histidine |
| Ile | I | Isoleucine |
| Lys | K | Lysine |
| Leu | L | Leucine |
| Met | M | Methionine |
| Asn | N | Asparagine |
| Pro | P | Proline |
| Gln | Q | Glutamine |
| Arg | R | Arginine |
| Ser | S | Serine |
| Thr | T | Threonine |
| Val | V | Valine |
| Trp | W | Tryptophan |
| Tyr | Y | Tyrosine |

Non-conventional amino acids and additional peptide building blocks are identified according to a three-letter code (with the exception of Ttds, which is a common four-letter abbreviation) found in Table 2.

TABLE 2

| Name | Abbreviation | Structure |
|---|---|---|
| 2-aminobutyric acid | Abu | 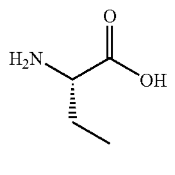 |
| 2-Amino-isobutyric acid | Aib | 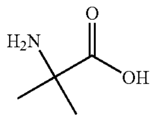 |

TABLE 2-continued
| Name | Abbreviation | Structure |
|---|---|---|
| β-Alanine | Bal | 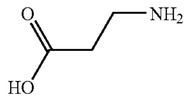 |
| β-Homoglutamatic acid | Bhe | 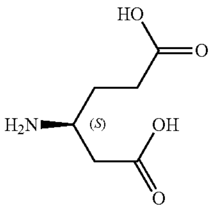 |
| β-Homophenylalanine | Bhf | 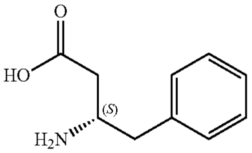 |
| β-Homolysine | Bhk | 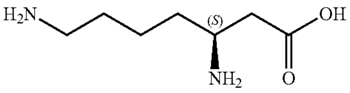 |
| β-Homoleucine | Bhl | 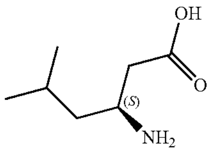 |
| β-Homoasparagine | Bhn | 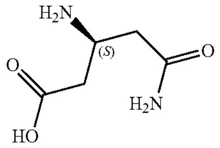 |
| β-Homoglutamine | Bhq | 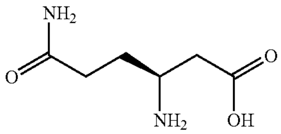 [SMILES: NC(=O)CC[C@H](N)CC(=O)O] |
| β-Homoarginine | Bhr | 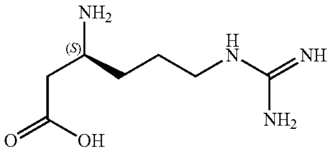 |
| β-Homoserine | Bhs | 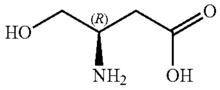 |
| β-Homotyrosine | Bhy | 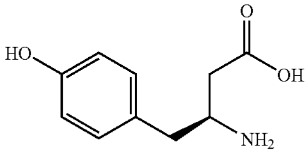 [SMILES: N[C@H](CC(=O)O)Cc1ccc(O)cc1] |

TABLE 2-continued
| Name | Abbreviation | Structure |
|---|---|---|
| β-Homoaspartic acid | Bhd | 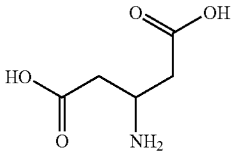 |
| β-Homovaline | Bhv, Btl | 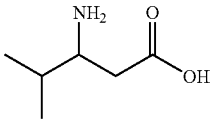 |
| β-Homoasparagin | Bhn, Btq | 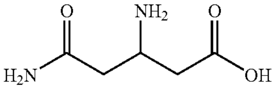 |
| (S)-Cyclohexylalanine | Cha | 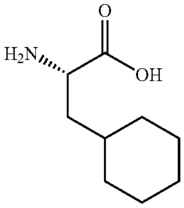 [SMILES: N[C@@H](CC1CCCCC1)C(=O)O] |
| (S)-Citrullin | Cit | 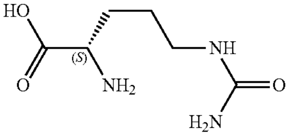 |
| (S)-2,4-Diaminobutyric acid | Dab | 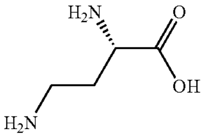 |
| (S)-Diaminopropionic acid | Dap | 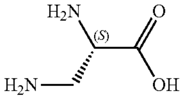 |
| (S)-2-Propargylglycine | Eag | 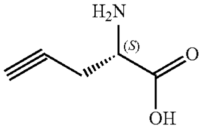 |
| (S)-N(omega)-nitro-arginine | Eew | 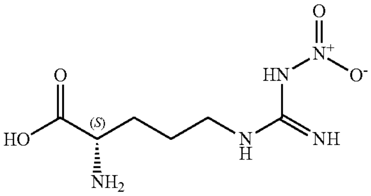 |
| L-homophenylalanine | Hfe | 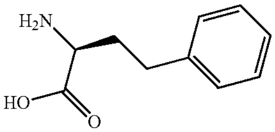 [SMILES: N[C@@H](CCc1ccccc1)C(=O)O] |

TABLE 2-continued
| Name | Abbreviation | Structure |
|---|---|---|
| (S)-Homo-arginine | Har | 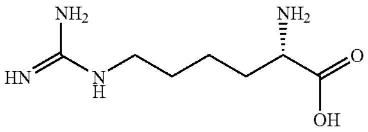 [SMILES: N=C(N)NCCCC[C@H](N)C(=O)O] |
| (S)-Homo-citrulline | Hci | 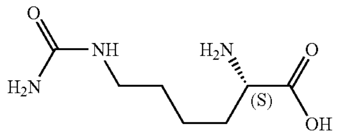 |
| (S)-Homo-cysteine | Hcy | 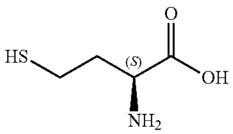 |
| (S)-2-Amino-5-methyl-hexanoic acid | Hle | 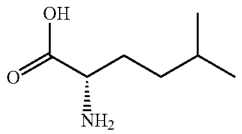 |
| (S)-Homo-lysine | Hly | 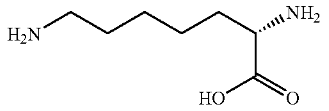 [SMILES: NCCCCC[C@H](N)C(=O)O] |
| (S)-Norleucine | Nle | 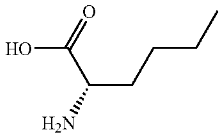 |
| (S)-N-Methylalanine | Nma | 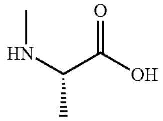 |
| (S)-N-Methyl-Aspartic acid | Nmd | 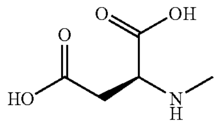 |
| (S)-N-Methyl-glutamic acid | Nme | 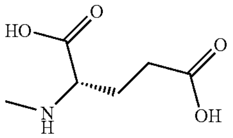 |
| (S)-N-Methyl-phenylalanine | Nmf | 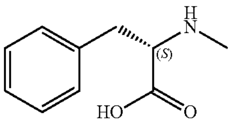 |
| N-Methyl-glycine | Nmg | 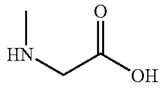 |

TABLE 2-continued
| Name | Abbreviation | Structure |
|---|---|---|
| (S)-N-Methyl-lysine | Nmk | 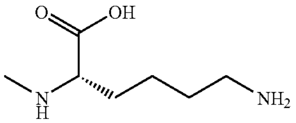 |
| (S)-N-Methyl-leucine | Nml | 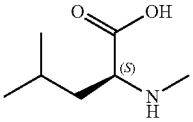 |
| (S)-N-Methyl-arginine | Nmr | 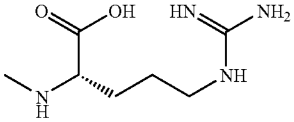 |
| (S)-N-Methyl-serine | Nms | 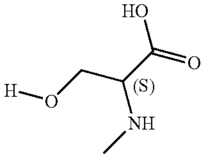 |
| (S)-N-Methyl-valine | Nmv | 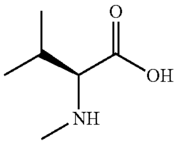 |
| (S)-N-Methyl-tyrosine | Nmy | 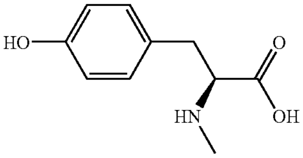 |
| (S)-2-Amino-pentanoic acid | Nva | 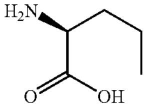 |
| (S)-2-Pyridyl-alanine | Opa | 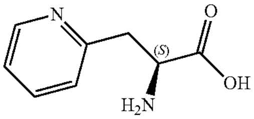 |
| (S)-Ornithine | Orn | 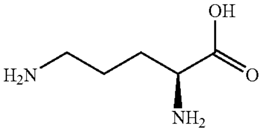 |
| L-phenylglycin | Phg | 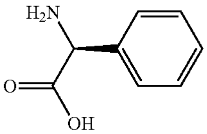 [SMILES: N[C@H](C(=O)O)c1ccccc1] |
| 4-Phenyl-butyric acid | PhPrCO | 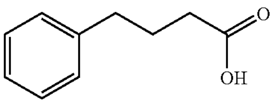 [SMILES: O=C(O)CCCc1ccccc1] |

TABLE 2-continued

| Name | Abbreviation | Structure |
|---|---|---|
| Polyethylene glycol | PEG | |
| Selenomethionine | Sem | 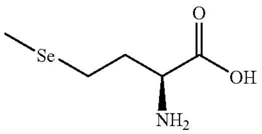 |
| 1,2,3,4-L-tetrahydroisoquinolinecarboxylic acid | Tic | 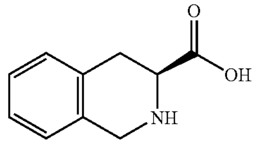 [SMILES: O=C(O)[C@@H]1Cc2ccccc2CN1] |
| (13-Amino-4,7,10-trioxa-tridecayl)- succinamic acid | Ttds | 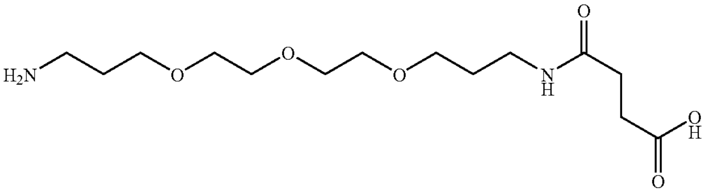 [SMILES: NCCCOCCOCCOCCCNC(=O)CCC(=O)O] |
| Carboxyfluorescein | FAM | 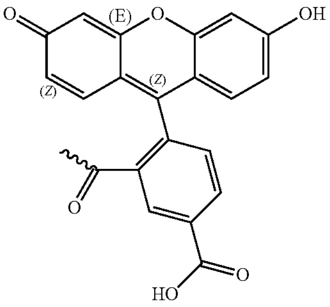 |

The amino acid sequences of the peptides provided herein are depicted in typical peptide sequence format, as would be understood by the ordinary skilled artisan. For example, the three-letter code or one-letter code of a conventional amino acid, or the three-letter code or abbreviation for a non-conventional amino acid, indicates the presence of the amino acid in a specified position within the peptide sequence. The code for each non-conventional amino acid is connected to the code for the next and/or previous amino acid in the sequence by a hyphen. Adjacent amino acids are connected by a chemical bond (typically an amide bond). The formation of the chemical bond removes a hydroxyl group from the 1-carboxyl group of the amino acid when it is located to the left of the adjacent amino acid (e.g., Hle-adjacent amino acid), and removes a hydrogen from the amino group of the amino acid when it is located on the right of the adjacent amino acid (e.g., adjacent amino acid-Hle). It is understood that both modifications can apply to the same amino acid and apply to adjacent conventional amino acids present in amino acid sequences without hyphens explicitly illustrated. Where an amino acid contains more than one amino and/or carboxy group in the amino acid side chain, the 2- or 3-amino group and/or the 1-carboxy group generally are used for the formation of peptide bonds. For non-conventional amino acids, a 3-letter code was used where the first letter indicates the stereochemistry of the C-α-atom. For example, a capital first letter indicates that the L-form of the amino acid is present in the peptide sequence, while a lower case first letter indicating that the D-form of the correspondent amino acid is present in the peptide sequence. When one-letter code is used, a lower case letter represents a D-amino acid, while an upper case letter represents an L-amino acid. Unless indicated to the contrary, the amino acid sequences are presented herein in N- to C-terminus direction.

The C-termini of several TFPI-binding peptide sequences described herein are explicitly illustrated by inclusion of an OH, $NH_2$, or an abbreviation for a specific terminating amine linked to the C-terminal amino acid code via a hyphen. The N-termini of several peptides described herein are explicitly illustrated by inclusion of a hydrogen (for a free N-terminus), or an abbreviation for a specific terminating carboxylic acid or other chemical group linked to the N-terminal amino acid code via a hyphen.

The invention provides a peptide comprising the amino acid sequence $X_7X_8X_9X_{10}X_{11}X_{12}X_{13}X_{14}X_{15}X_{16}X_{17}X_{18}X_{19}X_{20}X_{21}$ (SEQ ID NO: 3109), wherein (using single letter codes for amino acids)

$X_7$ is selected from the group consisting of L, P, K, S, W, V, N, and Q;

$X_8$ is selected from the group consisting of L, R, N, F, and I;

$X_9$ is selected from the group consisting of Y, V, P, and C;

$X_{10}$ is selected from the group consisting of F, L, and G;

$X_{11}$ is selected from the group consisting of L, W, V, A, M, T, and S;

$X_{12}$ is selected from the group consisting of T, F, V, R, A, D, L, E, S, and Y;

$X_{13}$ is selected from the group consisting of I, M, G, Q, D, and R;

$X_{14}$ is selected from the group consisting of G, W, Y, L, M, and H;

$X_{15}$ is selected from the group consisting of N, P, F, H, K, and Y;

$X_{16}$ is selected from the group consisting of M, D, E, V, G, and K;

$X_{17}$ is selected from the group consisting of G, I, R, S, T, and L;

$X_{18}$ is selected from the group consisting of M, K, L, and I;

$X_{19}$ is selected from the group consisting of Y, G, R, and S;

$X_{20}$ is selected from the group consisting of A, E, S, C, and Y; and $X_{21}$ is selected from the group consisting of A, V, K, and E.

In addition to the core structure set forth above, $X_7$-$X_{21}$, other structures that are specifically contemplated are those in which one or more additional amino acids are attached to the core structure (e.g., linked to the N-terminus or the C-terminus of the amino acid sequence $X_7$-$X_{21}$). Thus, the invention includes peptides comprising the core structure and further comprising one or more N-terminal amino acid(s) comprising an amino acid sequence selected from the group consisting of:

$X_6$, $X_5X_6$, $X_4X_5X_6$, $X_3X_4X_5X_6$ (SEQ ID NO: 3110), $X_2X_3X_4X_5X_6$ (SEQ ID NO: 3111), and $X_1X_2X_3X_4X_5X_6$ (SEQ ID NO: 3112);

wherein $X_6$ is directly linked to $X_7$ of the core structure amino acid sequence, and $X_1$ is selected from the group consisting of T and G;

$X_2$ is selected from the group consisting of F and V;

$X_3$ is selected from the group consisting of V, W, Y, and F;

$X_4$ is selected from the group consisting of D, Q, and S;

$X_5$ is selected from the group consisting of E, T, N, and S; and $X_6$ is selected from the group consisting of R, H, K, and A.

The peptide of the invention in one aspect comprises or consists of the amino acid sequence QSKKNVFVFGYFERLRAK (SEQ ID NO: 1).

In another embodiment, the peptide of the invention comprising the core structure comprises one or more C-terminal amino acid(s) comprising an amino acid sequence selected from the group consisting of:

$X_{22}$, $X_{22}X_{23}$, $X_{22}X_{23}X_{24}$, $X_{22}X_{23}X_{24}X_{25}$ (SEQ ID NO: 3113), $X_{22}X_{23}X_{24}X_{25}X_{26}$ (SEQ ID NO: 3114), and $X_{22}X_{23}X_{24}X_{25}X_{26}X_{27}$ (SEQ ID NO: 3115), wherein $X_{22}$ is directly linked to $X_{21}$ of the core structure amino acid sequence, and $X_{22}$ is selected from the group consisting of Q, I, E, W, R, L, and N;

$X_{23}$ is selected from the group consisting of L, V, M, and R;

$X_{24}$ is selected from the group consisting of K, L, A, and Y;

$X_{25}$ is F;

$X_{26}$ is G; and $X_{27}$ is T.

In one aspect, the peptide of the invention comprises or consists of the amino acid sequence VIVFTFRHNKLIGYERRY (SEQ ID NO: 4). It is also contemplated that the peptide of the invention comprises additional amino acids at both the N-terminus and the C-terminus of the core structure. In this aspect, the peptide comprises or consists of the amino acid sequence TFVDERLLYFLTIGNMGMYAAQLKF (SEQ ID NO: 3), GVWQTHPRYFWTMWPDIKGEVIVLFGT (SEQ ID NO: 5), KWFCGMRDMKGTMSCVWVKF (SEQ ID NO: 6), or ASFPLAVQLHVSKRSKEMA (SEQ ID NO: 7).

The invention further includes peptides comprising the amino acid sequence $X_3X_4X_5$-F-$X_7$-NVF-$X_{11}X_{12}$-GY-$X_{15}X_{16}$-RLRAK-$X_{22}$ (SEQ ID NO: 2), wherein $X_3$ is Y or F; $X_4$ is Q or S; $X_5$ is N or S; $X_7$ is K, N, or Q; $X_{11}$ is V, A, S, or T; $X_{12}$ is F, A, D, L, Q, S, or Y; $X_{15}$ is F, K, or Y; $X_{16}$ is E or D; and $X_{22}$ is L or N.

In addition, the invention provides a peptide that binds TFPI, wherein the peptide comprises the structure of formula (I): X1001-X1002-X1003-X1004-X1005-X1006-X1007-X1008-X1009-X1010-X1011-X1012-X1013-X1014-X1015-X1016-X1017-X1018-X1019-X1020 (SEQ ID NO: 3116). In formula (I), X1001 is an amino acid selected from the group consisting of Bhf, C, D, F, G, H, I, K, L, M, N, Nmf, Q, R, T, V, W and Y;

X1002 is an amino acid selected from the group consisting of G, K and Q;

X1003 is an amino acid selected from the group consisting of A, Aib, Bhs, C, D, E, F, G, H, I, K, L, M, N, P, Q, R, S, T, V, W and Y;

X1004 is an amino acid selected from the group consisting of, A, Aib, Bhk, C, D, E, F, G, H, I, K, k, L, M, N, Nmk, P, Q, R, S, T, V, W and Y;

X1005 is an amino acid selected from the group consisting of a, A, Aib, Bal, C, D, d, E, F, G, H, K, k, L, M, N, Nmg, p, Q, R, S, T, V, W and Y;

X1006 is an amino acid selected from the group consisting of A, Aib, Btq, C, D, E, F, G, H, I, K, L, M, N, Q, R, S T, V, W and Y;

X1007 is an amino acid selected from the group consisting of A, F, G, I, K, L, Nmv, P, Q, S, V, W and Y;

X1008 is an amino acid selected from the group consisting of F, H, K, W and Y;

X1009 is an amino acid selected from the group consisting of A, Aib, f, I, K, S, T and V;

X1010 is an amino acid selected from the group consisting of A, Aib, C, D, E, F, G, H, I, K, L, M, N, Nmf, P, Q, R, S, T, V, W and Y;

X1011 is an amino acid selected from the group consisting of Aib, C, K, G and Nmg;

X1012 is Y;

X1013 is an amino acid selected from the group consisting of A, Aib, C, E, F, G, H, K, L, M, Q, R, W and Y;

X1014 is an amino acid selected from the group consisting of A, Aib, Bhe, C, D, E, F, G, H, I, K, L, M, N, P, Q, R, S, T, V, W and Y;

X1015 is an amino acid selected from the group consisting of (omega-methyl)-R, D, E, K and R;

X1016 is L;

X1017 is an amino acid selected from the group consisting of (omega-methyl)-R, A, Aib, Bhr, C, Cha, Cit, D, Dab, Dap, E, Eag, Eew, F, G, H, Har, Hci, Hle, I, K, L, M, N, Nle, Nva, Opa, Orn, Q, R, S, T, V, W and Y;

X1018 is an amino acid selected from the group consisting of A, Bal, C, D, E, F, G, H, I, K, L, M, N, Q, R, S, T, V, W and Y; and X1019 is an amino acid selected from the group consisting of Bhk, K, R and V.

X1020 is either present or absent in formula (I) (i.e., in some instances, the peptide of the invention comprises the structure X1001-X1002-X1003-X1004-X1005-X1006-X1007-X1008-X1010-X1011-X1012-X1013-X1014-X1015-X1016-X1017-X1018-X1019 (SEQ ID NO: 3116)). When X1020 is present, it is an amino acid selected from the group consisting of Aib, Bhl, C, F, G, H, I, K, L, Nml, Q, R, S, T, V, W and Y.

For example, the peptide of the invention comprises the structure of formula (I) wherein X1001 is an amino acid selected from the group consisting of C, F, I, K, L, Nmf, V, M, W and Y; X1002 is Q; X1003 is an amino acid selected from the group consisting of A, C, D, E, H, K, M, I, N, Q, R, S, T and V; X1004 is an amino acid selected from the group consisting of A, Aib, C, D, E, G, H, F, I, K, k, L, M, N, Nmk, P, Q, R, S, V, W and Y; X1005 is an amino acid selected from the group consisting of a, A, Aib, Bal, C, d, E, D, F, G, H, K, k, L, M, N, Nmg, p, Q, R, S, T and Y; X1006 is an amino acid selected from the group consisting of A, Btq, C, D, G, I, K, H, L, M, N, Q, R, S, V and Y; X1007 is an amino acid selected from the group consisting of I, K, L, Q, V and Y; X1008 is an amino acid selected from the group consisting of F, H and Y; X1009 is an amino acid selected from the group consisting of f, I and V; X1010 is an amino acid selected from the group consisting of A, D, E, F, G, H, K, L, M, N, P, Q, R, S, T, V, W and Y; X1011 is an amino acid selected from the group consisting of G and Nmg; X1012 is Y; X1013 is an amino acid selected from the group consisting of Aib, C, F, H, L, W and Y; X1014 is an amino acid selected from the group consisting of A, Aib, Bhe, C, D, E, H, I, K, L, M, N, Q, R, S, T, V, W and Y; X1015 is an amino acid selected from the group consisting of E and R; X1016 is L; X1017 is an amino acid selected from the group consisting of (omega-methyl)-R, A, Aib, Bhr, C, Cha, Cit, Dab, Dap, Eag, Eew, F, H, Har, Hci, Hle, I, K, L, M, N, Nle, Nva, Opa, Orn, R, S, T, V and Y; X1018 is an amino acid selected from the group consisting of A, C, D, E, F, I, K, L, M, N, Q, R, V and W; X1019 is an amino acid selected from the group consisting of K and R; and X1020 is an amino acid selected from the group consisting of Aib, Bhl, F, K, L, R and W (when X1020 is present in the peptide).

In one aspect, the peptide of the invention comprises the structure of formula (I) wherein X1001 is an amino acid selected from the group consisting of F, L, Y and M; X1002 is Q; X1003 is an amino acid selected from the group consisting of M, Q, R, S, T and C; X1004 is an amino acid selected from the group consisting of Aib, K, L, P, R, E, G, I, Y, M and W; X1005 is an amino acid selected from the group consisting of a, Aib, D, d, G, H, K, k, N, Nmg, p, Q, R, A, E, C and M; X1006 is an amino acid selected from the group consisting of A, C, D, G, H, K, N, Q, R, S and M; X1007 is an amino acid selected from the group consisting of I and V; X1008 is an amino acid selected from the group consisting of F, H and Y; X1009 is V; X1010 is an amino acid selected from the group consisting of A, D, E, K, M, N, Q, R, F, H, P, S, V, W and Y; X1011 is G; X1012 is Y; X1013 is C or F; X1014 is an amino acid selected from the group consisting of A, C, D, E, K, L, M, N, Q, R, T, V and Aib; X1015 is R; X1016 is L; X1017 is an amino acid selected from the group consisting of A, Aib, C, Cha, Dab, Dap, Eag, Eew, H, Har, Hci, Hle, K, Nle, Nva, Opa, Orn, R, I, L, S and M; X1018 is an amino acid selected from the group consisting of A, L, N, M and R; X1019 is K; and X1020 is K or L.

When amino acid X1020 is absent from formula (I), the peptide of the invention in one aspect further comprises amino acid X1000 at the N-terminus of formula (I), such that the peptide comprises or consists of the structure of formula (II): X1000-X1001-X1002-X1003-X1004-X1005-X1006-X1007-X1008-X1009-X1010-X1011-X1012-X1013-X1014-X1015-X1016-X1017-X1018-X1019 (II) (SEQ ID NO: 3122). When X1000 is present in the peptide, X1000 is an amino acid selected from the group consisting of A, E, and P, while the amino acids of X1001-X1019 are as defined above.

In an additional aspect, the TFPI-binding peptide of the invention comprises the structure of formula (III): X1001-Q-X1003-X1004-X1005-X1006-I/V-X1008-V-X1010-G-Y-C/F-X1014-R-L-X1017-X1018-K-K/L (III) (SEQ ID NO: 3117). X1001, X1003, X1004, X1005, X1006, X1008, X1010, X1014, X1017 and X1018 in formula (III) are each independently selected from any amino acid. For example, in formula (III), X1001 is optionally an amino acid selected from the group consisting of Bhf, C, D, F, G, H, I, K, L, M, N, Nmf, Q, R, T, V, W and Y, such as an amino acid selected from the group consisting of C, F, I, K, L, Nmf, V, M, W and Y (e.g., an amino acid selected from the group consisting of F, L, Y and M);

X1003 is optionally an amino acid selected from the group consisting of A, Aib, Bhs, C, D, E, F, G, H, I, K, L, M, N, P, Q, R, S, T, V, W and Y, such as an amino acid selected from the group consisting of A, C, D, E, H, K, M, I, N, Q, R, S, T and V (e.g., the amino acid is M, Q, R, S, T or C);

X1004 is optionally an amino acid selected from the group consisting of, A, Aib, Bhk, C, D, E, F, G, H, I, K, k, L, M, N, Nmk, P, Q, R, S, T, V, W and Y, such as an amino acid selected from the group consisting of A, Aib, C, D, E, G, H, F, I, K, k, L, M, N, Nmk, P, Q, R, S, V, W and Y (e.g., an amino acid selected from the group consisting of Aib, K, L, P, R, E, G, I, Y, M and W);

X1005 is optionally an amino acid selected from the group consisting of a, A, Aib, Bal, C, D, d, E, F, G, H, K, k, L, M, N, Nmg, p, Q, R, S, T, V, W and Y, such as an amino acid selected from the group consisting of a, A, Aib, Bal, C, d, E, D, F, G, H, K, k, L, M, N, Nmg, p, Q, R, S, T and Y (e.g., the amino acid is a, Aib, D, d, G, H, K, k, N, Nmg, p, Q, R, A, E, C or M);

X1006 is optionally an amino acid selected from the group consisting of A, Aib, Btq, C, D, E, F, G, H, I, K, L, M, N, Q, R, S, T, V, W and Y, such as an amino acid selected from the group consisting of A, Btq, C, D, G, I, K, H, L, M, N, Q, R, S, V and Y (e.g., an amino acid selected from the group consisting of A, C, D, G, H, K, N, Q, R, S and M);

X1008 is optionally an amino acid selected from the group consisting of F, H, K, W and Y, such as an amino acid selected from the group consisting of F, H and Y;

X1010 is optionally an amino acid selected from the group consisting of A, Aib, C, D, E, F, G, H, I, K, L, M, N, Nmf, P, Q, R, S, T, V, W and Y, such as an amino acid selected from the group consisting of A, D, E, F, G, H, K, L, M, N, P, Q, R, S, T, V, W and Y (e.g., an amino acid selected from the group consisting of A, D, E, K, M, N, Q, R, F, H, P, S, V, W and Y);

X1014 is optionally an amino acid selected from the group consisting of A, Aib, Bhe, C, D, E, F, G, H, I, K, L, M, N, P, Q, R, S, T, V, W and Y, such as an amino acid selected from the group consisting of A, Aib, Bhe, C, D, E, H, I, K, L, M, N, Q, R, S, T, V, W and Y (e.g., A, C, D, E, K, L, M, N, Q, R, T, V or Aib);

X1017 is optionally an amino acid selected from the group consisting of (omega-methyl)-R, A, Aib, Bhr, C, Cha, Cit, D, Dab, Dap, E, Eag, Eew, F, G, H, Har, Hci, Hle, I, K, L, M, N, Nle, Nva, Opa, Orn, Q, R, S, T, V, W and Y, such as an amino acid selected from the group consisting of (omega-methyl)-R, A, Aib, Bhr, C, Cha, Cit, Dab, Dap, Eag, Eew, F, H, Har, Hci, Hle, I, K, L, M, N, Nle, Nva, Opa, Orn, R, S, T, V and Y (e.g., an amino acid selected from the group consisting of A, Aib, C, Cha, Dab, Dap, Eag, Eew, H, Har, Hci, Hle, K, Nle, Nva, Opa, Orn, R, I, L, S and M); and/or X1018 is optionally an amino acid selected from the group consisting of A, Bal, C, D, E, F, G, H, I, K, L, M, N, Q, R, S, T, V, W and Y, such as an amino acid selected from the group consisting of A, C, D, E, F, I, K, L, M, N, Q, R, V and W (e.g., an amino acid selected from the group consisting of A, L, N, M and R).

In some embodiments, the peptide of the invention comprises one or more additional amino acid residues attached to the N- or C-terminus of the amino acid sequence. For example, the peptide comprising the structure of any one of formulas (I)-(III), in some embodiments, further comprises one or more N-terminal amino acid(s) directly linked to X1001, wherein the N-terminal amino acid(s) comprise the amino acid sequence selected from the group consisting of

```
X1000,

X999-X1000,

X998-X999-X1000,

                                          (SEQ ID NO: 3123)
X997-X998-X999-X1000,

                                          (SEQ ID NO: 3124)
X996-X997-X998-X999-X1000,

                                          (SEQ ID NO: 3125)
X995-X996-X997-X998-X999-X1000,

                                          (SEQ ID NO: 3126)
X994-X995-X996-X997-X998-X999-X1000,

                                          (SEQ ID NO: 3127)
X993-X994-X995-X996-X997-X998-X999-X1000,

                                          (SEQ ID NO: 3128)
X992-X993-X994-X995-X996-X997-X998-X999-X1000,

                                          (SEQ ID NO: 3129)
X991-X992-X993-X994-X995-X996-X997-X998-X999-

X1000,
and

                                          (SEQ ID NO: 3130)
X990-X991-X992-X993-X994-X995-X996-X997-X998-X999-

X1000.
```

When the peptide comprises one or more N-terminal amino acids, X1000 is A or K; X999 is V or K; X998 is Q or K; X997 is L or K; X996 is R or K; X995 is G or K; X994 is V or K; X993 is G or K; X992 is S or K; X991 is K; and X990 is K.

In addition to the core structures set forth in formulas (I)-(III), other structures that are specifically contemplated are those in which one or more additional amino acids are attached to the C-terminus of the core structure directly linked to X1020. For example, the C-terminal addition optionally comprises an amino acid sequence selected from the group consisting of X1021, X1021-X1022, X1021-X1022-X1023, and X1021-X1022-X1023-X1024 (SEQ ID NO: 3131), wherein X1021 is T or K; X1022 is S or K; and X1023 and X1024 are K.

The invention further includes a TFPI-binding peptide comprising or consisting of an amino acid sequence having at least 60% identity (e.g., at least 65%, at least 70%, at least 75%, at least 80%, at least 85%, at least 90%, at least 95% or 100% identity) to the amino acid sequence Ac-FQSK-Nmg-NVFVDGYFERL-Aib-AKL-NH2 (formula IV) (SEQ ID NO: 164). In some instances, the peptide comprises or consists of the amino acid sequence of any one of formulas (I)-(III), as described herein. The invention also includes a peptide comprising or consisting of an amino acid sequence selected from the group consisting of SEQ ID NOs: 8-978 (e.g., a peptide comprising or consisting of the amino acid sequence selected from the group consisting of SEQ ID NOs: 8-741 and 962-972 (such as SEQ ID NOs: 8-741, 962-968, 971, or 972) and/or selected from the group consisting of 742-961 (such as SEQ ID NOs: 744-961) and/or selected from the group consisting of SEQ ID NOs: 973-978).

The peptides of the invention, in some instances, comprise intramolecular disulfide bonds. In this regard, the peptide comprising the structure of formulas (I)-(III) contains at least two cysteine residues (e.g., the peptide contains two cysteine residues) that are spaced apart by at least three amino acid residues such that the cysteines form an intramolecular disulfide bond. In some instances, the cysteines are spaced apart by more than three amino acid residues. For example, in the peptide comprising the structure of formulas (I), (II), or (III), any two of X1000, X1001, X1003, X1004, X1005, X1006, X1010, X1011, X1013, X1014, X1017, X1018, X1020 and X1021 are optionally cysteines capable of forming a disulfide bridge. Accordingly, in some aspects, the peptide contains two cysteine residues: one of X1000, X1005, X1010 and X1014 is cysteine, and one of X1006, X1010, X1017 and X1021 is a cysteine. The invention contemplates all of the possible combinations of cysteine pairs, e.g., X1000 and X1006 are C; X1000 and X1010 are C; X1000 and X1017 are C; X1005 and X1017 are C; X1010 and X1017 are C; X1010 and X1021 are C; or X1014 and X1021 are C.

The invention further provides a peptide that binds TFPI, the peptide comprising the structure of formula (V): X2001-X2002-X2003-X2004-X2005-X2006-[X2007-X2008-X2009-X2010-X2011-X2012-X2013-X2014-X2015-X2016-X2017-X2018]-X2019-X2020-X2021-X2022-X2023 (V) (SEQ ID NO: 3118), wherein the peptide forms a cyclic structure generated by a linkage, e.g., a disulfide bond, between X2007 and X2018 (denoted as brackets within formula (V)). In formula (V), X2001, X2002, and X2023 are independently either present or absent. When present, X2001 is an amino acid selected from the group consisting of A, D, E, F, G, H, I, K, L, P, R, S, T, V and W; X2002 an amino acid selected from the group consisting of A, D, E, F, G, H, I, K, L, M, P, R, S, T, V and W; and X2023 is an amino acid selected from the group consisting of A, D, E, F, G, I, K, L, R, S, T, V, W and Y. In addition, X2003 is an amino acid selected from the group consisting of A, F, I, K, L, R, S, T, V, W and Y;

X2004 is an amino acid selected from the group consisting of A, D, E, F, G, I, K, L, R, S, T, V and W;

X2005 is W;

X2006 is an amino acid selected from the group consisting of F, H, I, K, L, R, V and W;

X2007 is an amino acid selected from the group consisting of C, Hcy, Dap and K (e.g., C or Hcy);

X2008 is an amino acid selected from the group consisting of A, G, R, S and T;

X2009 is an amino acid selected from the group consisting of a, A, I, K, L, M, m, Nle, p, R, Sem, and V;

X2010 is an amino acid selected from the group consisting of A, G, I, K, L, P, R, S, T and V;

X2011 is an amino acid selected from the group consisting of D, E, G, S, and T;

X2012 is an amino acid selected from the group consisting of A, a, D, d, E, e, F, f, G, I, K, k, L, l, M, m, Nle, nle, P, p, R, r, S, s, Sem, T, t, V, v, W and w;

X2013 is an amino acid selected from the group consisting of A, D, d, E, e, F, G, I, K, L, R, S, s, T, V and W;

X2014 is an amino acid selected from the group consisting of A, D, E, F, G, I, K, L, M, R, S, T, V and W;

X2015 is an amino acid selected from the group consisting of A, D, E, F, G, I, K, L, M, Nle, R, S, T, V and W;

X2016 is an amino acid selected from the group consisting of A, D, E, F, I, K, L, M, Nle, R, S, Sem, T, V, W and Y;

X2017 is an amino acid selected from the group consisting of A, D, E, F, G, I, K, L, R, S, T, V, W and Y;

X2018 is an amino acid selected from the group consisting of C and D (e.g., X2018 is C);

X2019 is an amino acid selected from the group consisting of A, F, I, L, S, T, V and W;

X2020 is an amino acid selected from the group consisting of F and W;

X2021 is an amino acid selected from the group consisting of I, L and V; and

X2022 is an amino acid selected from the group consisting of A, D, E, F, G, I, K, L, P, R, S, T, V, and W.

In some instances, in the peptide of the invention comprising the structure of formula (V), X2001 is optionally an amino acid selected from the group consisting of A, D, F, G, H, K, L, P and S, such as an amino acid selected from the group consisting of A, D, F, G, H, K, L and S (when X2001 is present);

X2002 is optionally an amino acid selected from the group consisting of A, D, F, G, H, K, L, P, R and S, such as an amino acid selected from the group consisting of A, F, H, K, L, M, R and S (e.g., H, F, M or R) (when X2002 is present);

X2003 is optionally an amino acid selected from the group consisting of A, F, K, L, S and Y, such as an amino acid selected from the group consisting of F, S and Y (e.g., F or Y);

X2004 is optionally an amino acid selected from the group consisting of A, D, F, G, K, L and S (e.g., K);

X2005 is optionally W;

X2006 is optionally an amino acid selected from the group consisting of F, H, K and L (e.g., F or H);

X2007 is optionally an amino acid selected from the group consisting of C and HcY (e.g., X2007 is C);

X2008 is optionally an amino acid selected from the group consisting of A, G and S;

X2009 is optionally an amino acid selected from the group consisting of a, A, K, L, V, M, m, Nle, Sem, and p, such as an amino acid selected from the group consisting of M, Nle, p and V (e.g., M, Sem, or V);

X2010 is optionally an amino acid selected from the group consisting of A, G, K, L, P, R and S, such as an amino acid selected from the group consisting of A, K, L, P, R and S (e.g., K, P, or R);

X2011 is optionally an amino acid selected from the group consisting of D, G and S (e.g., D or S);

X2012 is optionally an amino acid selected from the group consisting of A, a, D, d, F, f, G, K, k, L, l, M, m, Nle, P, S and s, such as an amino acid selected from the group consisting of D, d, F, f, G, K, k, L, l, M, Nle, P, S, and Sem (e.g., an amino acid selected from the group consisting of F, L, l, Sem, and M);

X2013 is optionally an amino acid selected from the group consisting of A, D, d, F, G, K, L, S and s, such as an amino acid selected from the group consisting of A, D, F, G, K, L and S (e.g., D, G, K, or S);

X2014 is optionally an amino acid selected from the group consisting of D, F, G, K, L and S (e.g., D or G);

X2015 is optionally an amino acid selected from the group consisting of A, D, F, G, I, K, L, M, Nle, S and T (e.g., I or T);

X2016 is optionally an amino acid selected from the group consisting of D, F, K, L, M, Nle, S, and Y, such as an amino acid selected from the group consisting of D, F, K, L, M, Nle, S, Sem, and Y (e.g., D, F, M, Sem, or Y);

X2017 is optionally an amino acid selected from the group consisting of A, D, F, G, K, L, S, T and Y (e.g., S or T);

X2018 is optionally C;

X2019 is optionally an amino acid selected from the group consisting of A, F, L, S and V (e.g., A or V);

X2020 is optionally an amino acid selected from the group consisting of F and W (e.g., W);

X2021 is optionally an amino acid selected from the group consisting of L and V (e.g., V);

X2022 is optionally an amino acid selected from the group consisting of A, D, F, G, K, L, P, R, S and W, such as an amino acid selected from the group consisting of A, F, G, K, L, P, R, S and W (e.g., an amino acid selected from the group consisting of F, L, K, R, P and W); and X2023 is optionally an amino acid selected from the group consisting of A, D, F, G, K, L, M, S and Y, such as an amino acid selected from the group consisting of A, D, F, G, L M, S and Y (e.g., an amino acid sequence selected from the group consisting of A, D, F, M, S and Y) (when X2023 is present).

The invention further includes a peptide that binds TFPI, wherein the peptide comprises the structure of formula (VI): X2001-X2002-F/Y-K-W-F/H-[C-X2008-M/V-X2010-D-X2012-X2013-G-I/T-X2016-S/T-C]-A/V-W-V-X2022-X2023 (VI) (SEQ ID NO: 3119). In the peptide comprising the structure of formula (VI), X2001, X2002 and X2023 are each independently present or absent. If X2001, X2002, and/or X2023 are present, any of X2001, X2002 and X2023 is independently selected from any amino acid. In addition, X2008, X2010, X2012, X2013, X2016, and X2022 are each independently selected from any amino acid.

In some aspects, in the peptide of formula (VI),

X2001 is optionally an amino acid selected from the group consisting of A, D, E, F, G, H, I, K, L, P, R, S, T, V and W, such as an amino acid selected from the group consisting of A, D, F, G, H, K, L, P and S (e.g., an amino acid selected from the group consisting of A, D, F, G, H, K, L and S) (when X2001 is present);

X2002 is optionally an amino acid selected from the group consisting of A, D, E, F, G, H, I, K, L, M, P, R, S, T, V and W, such as an amino acid selected from the group consisting of A, D, F, G, H, K, L, M, P, R and S (e.g., an amino acid selected from the group consisting of A, F, H, K, L, M, R and S, such as H, F, M, or R) (when X2002 is present);

X2008 is optionally an amino acid selected from the group consisting of A, G, R, S and T, such as an amino acid selected from the group consisting of A, G and S;

X2010 is optionally an amino acid selected from the group consisting of A, G, I, K, L, P, R, S, T and V, such as an amino acid selected from the group consisting of A, G, K, L, P, R and S (e.g., an amino acid selected from the group consisting of A, K, L, P, R and S, such as K, P or R);

X2012 is optionally an amino acid selected from the group consisting of A, a, D, d, E, e, F, f, G, I, I, K, k, L, l, M, m, Nle, nle, P, p, R, r, S, s, Sem, T, t, V, v, W and w, such as an amino acid selected from the group consisting of A, a, D, d, F, f, G, K, k, L, l, M, m, Nle, P, S, s, and Sem (e.g., an amino acid selected from the group consisting of D, d, F, f, G, K, k, L, l, M, Nle, P, S, and Sem, such as F, L, l, Sem, or M);

X2013 is optionally an amino acid selected from the group consisting of A, D, d, E, e, F, G, I, K, L, R, S, s, T, V and W, such as an amino acid selected from the group consisting of A, D, d, F, G, K, L, S and s (e.g., an amino acid selected from the group consisting of A, D, F, G, K, L and S, such as D, G, K or S);

X2016 is optionally an amino acid selected from the group consisting of A, D, E, F, I, K, L, M, Nle, R, S, Sem, T, V, W and Y, such as an amino acid selected from the group consisting of D, F, K, L, M, Nle, S Sem, and Y (e.g., an amino acid selected from the group consisting of D, F, K, L, M, Nle, S, Sem, such as F, Sem, or M);

X2022 is optionally an amino acid selected from the group consisting of A, D, E, F, G, I, K, L, P, R, S, T, V, and W, such as an amino acid selected from the group consisting of A, D, F, G, K, L, P, R, S and W (e.g., an amino acid selected from the group consisting of A, F, G, K, L, P, R, S and W, such as F, L, K, R, P or W); and/or X2023 is optionally an amino acid selected from the group consisting of A, D, E, F, G, I, K, L, R, M, S, T, V, W and Y, such as an amino acid selected from the group consisting of A, D, F, G, K, L, M, S and Y (e.g., an amino acid selected from the group consisting of A, D, F, G, L M, S and Y, such as A, D, F, M, S or Y) (when X2023 is present).

The TFPI-binding peptide of the invention, in one aspect, comprises an amino acid sequence having at least 60% identity (e.g., at least 60%, at least 65%, at least 70%, at least 75%, at least 80%, at least 85%, at least 90%, at least 95% or 100% identity) to the sequence of formula VII: Ac-FYYKWH[CG-MRDMKGTMSC]AWVKF-NH2 (VII) (SEQ ID NO: 1040). Optionally, the peptide comprises or consists of the amino acid sequence of formula (V)-(VII) as defined herein. The invention also includes a peptide comprising or consisting of the amino acid sequence selected from the group consisting of SEQ ID NOs: 1001-1293 (e.g., a peptide comprising or consisting of the amino acid sequence selected from the group consisting of SEQ ID NOs: 1001-1212 and 1290-1291 (such as SEQ ID NOs: 1001-120, 1290, or 1291) and/or selected from the group consisting of SEQ ID NOs: 1213-1289 and/or selected from the group consisting of 1292 and 1293).

The invention further provides a TFPI-binding peptide comprising the structure of formula (VIII): X3001-X3002-X3003-X3004-X3005-X3006-X3007-X3008-X3009-X3010-X3011-X3012-X3013-X3014-X3015-X3016-X3017-X3018-X3019-X3020-X3021 (VIII) (SEQ ID NO: 3120). In formula (VIII), X3001 and X3002 are independently either present or absent in the peptide. If present, X3001 is an amino acid selected from the group consisting of A, C, D, F, G, I, K, L, M, N, P, Q, R, S, T, W, E, H and Y; and X3002 is an amino acid selected from the group consisting of A, C, D, F, H, K, M, N, P, R, S, T, W, Y, G, I and L. In addition, X3003 is an amino acid selected from the group consisting of A, C, D, E, F, G, H, I, K, L, M, N, P, Q, R, S, T, W and Y;

X3004 is an amino acid selected from the group consisting of A, C, D, E, F, G, H, I, K, L, M, N, Q, R, S, T, V, W, Y and P;

X3005 is an amino acid selected from the group consisting of C, D, F, G, H, I, K, L, M, N, P, R, S, T, V, W and Y;

X3006 is an amino acid selected from the group consisting of A, W, C, K, P, R and H;

X3007 is an amino acid selected from the group consisting of Q, A, C, F, G, H, I, K, L, N, R, S, T, W and Y;

X3008 is an amino acid selected from the group consisting of A, C, F, G, H, K, L, M, N, P, Q, R, S, T, V, W, Y and I;

X3009 is an amino acid selected from the group consisting of A, C, F, G, H, I, L, M, R, S, T, V, W, Y and K;

X3010 is an amino acid selected from the group consisting of A, C, F, G, H, I, K, L, M, N, P, Q, R, S, T, V, W and Y;

X3011 is an amino acid selected from the group consisting of A, G, I, K, L, M, N, Q, R, S, T, V, W, Y, C, F and H;

X3012 is an amino acid selected from the group consisting of A, C, H, I, K, L and R;

X3013 is an amino acid selected from the group consisting of A, C, F, G, H, K, L, M, R, S, V, W, Y and I;

X3014 is an amino acid selected from the group consisting of A, C, F, G, H, I, L, M, N, Q, R, S, T, V, W, Y and K;

X3015 is an amino acid selected from the group consisting of A, K and R;

X3016 is an amino acid selected from the group consisting of A, F, K and R;

X3017 is an amino acid selected from the group consisting of A, C, F, G, I, K, L, N, Q, R, S, T, V, W, Y, H, A and M;

X3018 is an amino acid selected from the group consisting of A, C, F, I, K, L, M, Q, R, V, W and Y;

X3019 is an amino acid selected from the group consisting of A, C, D, E, F, G, H, K, L, N, P, Q, R, V, W, Y and I;

X3020 is an amino acid selected from the group consisting of A, C, F, G, H, K, L, M, N, Q, R, V, W, Y, I and P; and X3021 is an amino acid selected from the group consisting of A, C, H, I, K, L, M, N, P, Q, R, T, V, W, Y, F and G.

In some aspects of the invention, the peptide comprises the sequence of formula (VIII), wherein X3001 is optionally an amino acid selected from the group consisting of A, C, D, G, I, K, L, M, N, P, Q, R, S, T, W, E, H and Y, such as an amino acid selected from the group consisting of A, C, D, G, K, L, M, N, P, R, S, T, E, H and Y (when X3001 is present);

X3002 is optionally an amino selected from the group consisting of C, F, H, K, R, S, W, Y, G, I and L, such as an amino acid selected from the group consisting of C, K, R, W, Y, G, I and L (when X3002 is present);

X3003 is optionally an amino acid selected from the group consisting of A, C, D, F, G, H, I, K, L, M, N, P, Q, R, S, T and W, such as an amino acid selected from the group consisting of A, C, G, H, I, K, L, M, R, S, T and W;

X3004 is optionally an amino acid selected from the group consisting of A, C, D, G, H, I, K, L, M, N, R, S, T, V and P, such as an amino acid selected from the group consisting of A, C, G, H, I, K, L, M, N, R, S, T and P;

X3005 is optionally an amino acid selected from the group consisting of C, F, H, I, K, M, R, T, W and Y, such as an amino acid selected from the group consisting of C, F, H, K, R and W;

X3006 is optionally an amino acid selected from the group consisting of P, H and A;

X3007 is optionally an amino acid selected from the group consisting of C, G, R, W, A and L, such as an amino acid selected from the group consisting of L, C, R and W;

X3008 is optionally an amino acid selected from the group consisting of A, C, F, G, H, K, L, M, N, Q, R, T, V, W, Y and I, such as an amino acid selected from the group consisting of A, C, F, H, K, R, V, W, Y and I;

X3009 is optionally an amino acid selected from the group consisting of C, I, R, V and K, such as an amino acid selected from the group consisting of C, R, V and K;

X3010 is optionally an amino acid selected from the group consisting of A, C, G, H, I, K, L, M, Q, R, S and T, such as an amino acid selected from the group consisting of A, C, K, L, Q, R and S;

X3011 is optionally an amino acid selected from the group consisting of A, I, K, L, M, R, S, V, W, C, F and H, such as an amino acid selected from the group consisting of I, K, L, M, R, V, W, C, F and H;

X3012 is optionally an amino acid selected from the group consisting of H and R (e.g., H);

X3013 is optionally an amino acid selected from the group consisting of C, F, K, L, M, R, V and I, such as an amino acid selected from the group consisting of C, K, R, V and I;

X3014 is optionally an amino acid selected from the group consisting of A, M, C, F, H, I, L, N, R, S, V, W and K, such as an amino acid selected from the group consisting of A, S, C, F, H, I, R and K;

X3015 is optionally K or R;

X3016 is optionally K or R;

X3017 is optionally an amino acid selected from the group consisting of A, C, F, G, I, K, L, N, Q, R, S, T, V, W, H, A and M, such as an amino acid selected from the group consisting of C, G, I, K, L, N, Q, R, S, T, V, H, A and M;

X3018 is optionally an amino acid selected from the group consisting of A, K, C, I, L, R and W (e.g., K, C, I, R, or W);

X3019 is optionally an amino acid selected from the group consisting of A, C, E, H, K, N, Q, R and I, such as an amino acid selected from the group consisting of C, E, H, K, R and I;

X3020 is optionally an amino acid selected from the group consisting of C, H, L, M, R, V, I and P (e.g., C, M, I, or P); and X3021 is optionally an amino acid selected from the group consisting of A, C, H, I, K, L, M, N, Q, R, V, W, Y, F and G, such as an amino acid selected from the group consisting of A, C, H, I, K, L, M, N, Q, R, V, W, F and G.

The invention further provides a peptide that binds TFPI and comprises the structure of formula (IX): X3001-X3002-X3003-X3004-X3005-X3006-X3007-X3008-X3009-X3010-X3011-H-X3013-X3014-K/R-R-X3017-X3018-X3019-X3020-X3021 (IX) (SEQ ID NO: 3121). In formula (IX), X3001 and X3002 are independently either present or absent in the peptide. If present, X3001 and/or X3002 are independently selected from any amino acid. Likewise, X3003, X3004, X3005, X3006, X3007, X3008, X3009, X3010, X3011, X3013, X3014, X3017, X3018, X3019, X3020 and X3021 are each independently selected from any amino acid. When present, X3001 is optionally an amino acid selected from the group consisting of A, C, D, F, G, I, K, L, M, N, P, Q, R, S, T, W, E, H and Y, such as an amino acid selected from the group consisting of A, C, D, G, I, K, L, M, N, P, Q, R, S, T, W, E, H and Y (e.g., an amino acid selected from the group consisting of A, C, D, G, K, L, M, N, P, R, S, T, E, H and Y) Likewise, when present, X3002 is optionally an amino acid selected from the group consisting of A, C, D, F, H, K, M, N, P, R, S, T, W, Y, G, I and L, such as an amino acid selected from the group consisting of C, F, H, K, R, S, W, Y, G, I and L (e.g., an amino acid selected from the group consisting of C, K, R, W, Y, G, I and L). Also with respect to formula (IX), X3003 is optionally an amino acid selected from the group consisting of A, C, D, E, F, G, H, I, K, L, M, N, P, Q, R, S, T, W, and Y, such as an amino acid selected from the group consisting of A, C, D, F, G, H, I, K, L, M, N, P, Q, R, S, T and W (e.g., an amino acid selected from the group consisting of A, C, G, H, I, K, L, M, R, S, T and W);

X3004 is optionally an amino acid selected from the group consisting of A, C, D, E, F, G, H, I, K, L, M, N, Q, R, S, T, V, W, Y and P, such as an amino acid selected from the group consisting of A, C, D, G, H, I, K, L, M, N, R, S, T, V and P (e.g., an amino acid selected from the group consisting of A, C, G, H, I, K, L, M, N, R, S, T and P);

X3005 is optionally an amino acid selected from the group consisting of C, D, F, G, H, I, K, L, M, N, P, R, S, T, V, W and Y, such as an amino acid selected from the group consisting of C, F, H, I, K, M, R, T, W and Y (e.g., an amino acid selected from the group consisting of C, F, H, K, R and W);

X3006 is optionally an amino acid selected from the group consisting of A, W, C, K, P, R and H, such as an amino acid selected from the group consisting of P, H and A;

X3007 is optionally an amino acid selected from the group consisting of Q, A, C, F, G, H, I, K, L, N, R, S, T, W and Y, such as an amino acid selected from the group consisting of C, G, R, W, A and L (e.g., L, C, R or W);

X3008 is optionally an amino acid selected from the group consisting of A, C, F, G, H, K, L, M, N, P, Q, R, S, T, V, W, Y and I, such as an amino acid selected from the group consisting of A, C, F, G, H, K, L, M, N, Q, R, T, V, W, Y and I (e.g., an amino acid selected from the group consisting of A, C, F, H, K, R, V, W, Y and I);

X3009 is optionally an amino acid selected from the group consisting of A, C, F, G, H, I, L, M, R, S, T, V, W, Y and K, such as an amino acid selected from the group consisting of C, I, R, V and K (e.g., C, R, V or K);

X3010 is optionally an amino acid selected from the group consisting of A, C, F, G, H, I, K, L, M, N, P, Q, R, S, T, V, W and Y, such as an amino acid selected from the group consisting of A, C, G, H, I, K, L, M, Q, R, S and T (e.g., an amino acid selected from the group consisting of A, C, K, L, Q, R and S);

X3011 is optionally an amino acid selected from the group consisting of A, G, I, K, L, M, N, Q, R, S, T, V, W, Y, C, F and H, such as an amino acid selected from the group consisting of A, I, K, L, M, R, S, V, W, C, F and H (e.g., an amino acid selected from the group consisting of I, K, L, M, R, V, W, C, F and H);

X3013 is optionally an amino acid selected from the group consisting of A, C, F, G, H, K, L, M, R, S, V, W, Y and I, such as an amino acid selected from the group consisting of C, F, K, L, M, R, V, and I (e.g., C, K, R, V, or I);

X3014 is optionally an amino acid selected from the group consisting of A, C, F, G, H, I, L, M, N, Q, R, S, T, V, W, Y and K, such as an amino acid selected from the group consisting of A, M, C, F, H, I, L, N, R, S, V, W and K (e.g., an amino acid selected from the group consisting of A, S, C, F, H, I, R and K);

X3017 is optionally an amino acid selected from the group consisting of A, C, F, G, I, K, L, N, Q, R, S, T, V, W, Y, H, A and M, such as an amino acid selected from the group consisting of A, C, F, G, I, K, L, N, Q, R, S, T, V, W, H, A and M (e.g., an amino acid selected from the group consisting of C, G, I, K, L, N, Q, R, S, T, V, H, A and M);

X3018 is optionally an amino acid selected from the group consisting of A, C, F, I, K, L, M, Q, R, V, W and Y, such as an amino acid selected from the group consisting of A, K, C, I, L, R and W (e.g., K, C, I, R, or W);

X3019 is optionally an amino acid selected from the group consisting of A, C, D, E, F, G, H, K, L, N, P, Q, R, V, W, Y and I, such as an amino acid selected from the group consisting of A, C, E, H, K, N, Q, R and I (e.g., C, E, H, K, R, or I);

X3020 is optionally an amino acid selected from the group consisting of A, C, F, G, H, K, L, M, N, Q, R, V, W, Y, I and P, such as an amino acid selected from the group consisting of C, H, L, M, R, V, I and P (e.g., C, M, I, or P); and/or X3021 is optionally an amino acid selected from the group consisting of A, C, H, I, K, L, M, N, P, Q, R, T, V, W, Y, F and G, such as an amino acid selected from the group consisting of A, C, H, I, K, L, M, N, Q, R, V, W, Y, F and G (e.g., an amino acid selected from the group consisting of A, C, H, I, K, L, M, N, Q, R, V, W, F and G).

The TFPI-binding peptide of the invention comprises, in some aspects, an amino acid sequence having at least 60% identity (e.g., at least 65%, at least 70%, at least 75%, at least 80%, at least 85%, at least 90%, at least 95% or 100% identity) to the sequence of formula (X): Ac-GYASFPWFVQLHVHKRSWEMA-NH2 (X) (SEQ ID NO: 223). Optionally, the peptide comprises or consists of the amino acid sequence of formula (VIII)-(IX) as defined herein. As used herein, "at least 60% identity" and similar terms encompass any integer from, e.g., 60%, to 100%, such as 60%, 61%, 62%, and the like. Also, the term "at least [percentage] identity" encompasses any percentage that is greater than or equal to the number of identical amino acids divided by the total number of amino acids of the peptide of the invention ([at least percentage identity]≧[number of identical amino acids]/[total number of amino acids of the peptide of the invention]).

The invention also includes a peptide comprising or consisting of the amino acid sequence selected from the group consisting of SEQ ID NOs: 2001-2498 (e.g., a peptide comprising or consisting of the amino acid sequence selected from the group consisting of SEQ ID NOs: 2001-2296 and 2498 (such as SEQ ID NOs: 2001-2126, 2128-2296, or 2498) and/or selected from the group consisting of SEQ ID NOs: 2297-2497 (such as SEQ ID NOs: 2298-2497)). The invention further provides a peptide comprising or consisting of the amino acid sequence selected from the group consisting of SEQ ID NOs: 3001-3108 (e.g., a peptide comprising or consisting of the amino acid sequence selected from the group consisting of SEQ ID NOs: 3001-3064 (such as SEQ ID NOs: 3001-3048, 3051-3053, 3055, or 3057-3064) and/or selected from the group consisting of SEQ ID NOs: 3065-3084 (such as SEQ ID NOs: 3066-3084) and/or selected from the group consisting of SEQ ID NOs: 3085-3108).

The peptide of SEQ ID NOs: 1-7 also, in some aspects, comprises one or more amino acids attached at the N- or C-terminus of SEQ ID NOs: 1-7. For example, the invention includes a peptide comprising or consisting of the amino acid sequence of JBT0047, JBT0051, JBT0055, JBT0131, JBT0132, JBT0133, JBT0155, JBT0158, JBT0162, JBT0163, JBT0164, JBT0166, JBT0169, JBT0170, JBT0171, JBT0174, JBT0175, or JBT0293, all of which comprise the amino acid sequence of SEQ ID NO: 1. Exemplary peptides comprising the amino acid sequence of SEQ ID NO: 2 include peptides comprising or consisting of the amino acid sequence of JBT0294, JBT0295, JBT0296, JBT0297, JBT0298, JBT0299, JBT0300, JBT0301, JBT0302, JBT0303, JBT0304, JBT0305, JBT0306, JBT0307, JBT0308, JBT0309, JBT0310, or JBT0311. Exemplary peptides comprising the amino acid sequence of SEQ ID NO: 3 comprise or consist of the amino acid sequence of JBT0049, JBT0053, JBT0057, JBT0190, JBT0193, or JBT0197. The invention further includes a peptide comprising or consisting of the amino acid sequence of JBT0050, JBT0054, JBT0058, JBT0129, JBT0130, JBT0205, JBT0208, JBT0211, JBT0212, JBT0217, JBT0218, or JBT0219, all of which include the amino acid sequence of SEQ ID NO: 4. Exemplary peptides comprising SEQ ID NO: 5 include those comprising or consisting of the amino acid sequence of JBT0101, JBT0052, JBT0103, JBT0178, or JBT0182. The invention additionally includes a peptide comprising or consisting of the amino acid sequence of JBT0120, JBT0124, JBT0247, JBT0248, JBT0251, or JBT0252, each of which include the amino acid sequence of SEQ ID NO: 6. A peptide including the amino acid sequence of SEQ ID NO: 7, e.g., a peptide comprising or consisting of the amino acid sequence of JBT0122, JBT0126. JBT0221, JBT0224, JBT0225, JBT0226, JBT0228, JBT0232, or JBT0233, also provided by the invention. The peptides described herein are set forth in Table 5 of Example 1 and in FIGS. 12-18.

In certain embodiments, the peptide of the invention comprises or consists of the amino acid sequence of JBT0047, JBT0049, JBT0101, JBT0120, or JBT0122 or any of the inventive peptides described herein (e.g., a peptide comprising or consisting of the amino acid sequence of any one of SEQ ID NOs: 1-3108, such as a peptide comprising or consisting of the amino acid sequence of any one of SEQ ID NOs: 8-741, 744-968, 971-978, 1001-1210, 1213-1289, 1290-1293, 2001-2126, 2128-2296, 2298-2498, 3001-3048, 3051-3053, 3055, 3057-3064, and 3067-3108), or a variant of any of the foregoing. By "variant" is meant a peptide comprising one or more amino acid substitutions, amino acid deletions, or amino acid additions to a parent amino acid sequence. Variants include, but are not limited to, peptides having an amino acid sequence that is at least 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to any of the amino acid sequences provided herein while retaining the ability to bind TFPI and/or inhibit TFPI activity. In one embodiment, the peptide comprises or consists of the amino acid sequence of JBT0132, JBT0303, JBT0193, JBT0178, JBT0120, or JBT0224.

In one aspect, the peptide of the invention consists of 40 amino acids or less, such as 35 amino acids or less. Optionally, the peptide of the invention consists of 25 amino acids or less, or 10 amino acids or less. In various embodiments, the peptide comprises 15-35 amino acid residues (e.g., 15, 16, 17, 18, 19, 20, 21, 22, 23, 24, 25, 26, 27, 28, 29, 30, 31, 32, 33, 34, or 35 amino acid residues). However, it is also contemplated that a peptide described herein comprising one or more deletions is suitable in the context of the invention so long as the peptide blocks TFPI inhibition of the coagulation cascade and, optionally, binds TFPI. In one aspect, the peptide comprising one or more deletions is suitable in the context of the invention so long as the peptide binds TFPI and, optionally, blocks TFPI inhibition of the coagulation cascade. In some aspects, amino acids are removed from within the amino acid sequence, at the N-terminus, and/or at the C-terminus. Such peptide fragments can comprise 3-14 amino acid residues (e.g., 3, 4, 5, 6, 7, 8, 9, 10, 11, 12, 13, or 14 amino acid residues).

Optionally, the peptide of the invention comprises one or more amino acid substitutions (with reference to any of the amino acid sequences provided herein) that do not destroy the ability of the peptide to bind and/or inhibit TFPI. For instance, peptides comprising or consisting of the amino acid sequence selected from the group consisting of JBT0294, JBT0295, JBT0296, JBT0297, JBT0298, JBT0299, JBT0300, JBT0301, JBT0302, JBT0303, JBT0304, JBT0305, JBT0306, JBT0307, JBT0308, JBT0309, JBT0310, or JBT0311 are substitutional mutants of the amino acid sequence of JBT0293 (the amino acid sequence of SEQ ID NO: 1 directly linked to a phenylalanine residue at the N-terminus and a lysine reside at the C-terminus) (see FIG. 4). Amino acid substitutions include, but are not limited to, those which: (1) reduce susceptibility to proteolysis, (2) reduce susceptibility to oxidation, (3) alter binding affinities, and/or (4) confer or modify other physiochemical or functional properties on a peptide. In one aspect, the substitution is a conservative substitution, wherein an amino acid residue is replaced with an amino acid residue having a similar side chain. Families of amino acid residues having similar side chains have been defined within the art, and include amino acids with basic side chains (e.g., lysine, arginine, and histidine), acidic side chains (e.g., aspartic acid and glutamic acid), uncharged polar side chains (e.g., glycine, asparagine, glutamine, serine, threonine, tyrosine, and cysteine), nonpolar side chains (e.g., alanine, valine, leucine, isoleucine, proline, phenylalanine, methionine, and tryptophan), beta-branched side chains (e.g., threonine, valine, and isoleucine) and aromatic side chains (e.g., tyrosine, phenylalanine, tryptophan, and histidine). It will be appreciated, however, that a practitioner is not limited to creating conservative substitutions so long as the resulting peptide retains the ability to downregulate, in whole or in part, TFPI activity. The invention also embraces TFPI-inhibitory peptides comprising atypical, non-naturally occurring amino acids, which are well known in the art. Exemplary non-naturally occurring amino acids include ornithine, citrulline, hydroxyproline, homoserine, phenylglycine, taurine, iodotyrosine, 2,4-diaminobutyric acid, α-amino isobutyric acid, 4-aminobutyric acid, 2-amino butyric acid, y-amino butyric acid, 2-amino isobutyric acid, 3-amino propionic acid, norleucine, norvaline, sarcosine, homocitrulline, cysteic acid, t-butylglycine, t-butylalanine, phenylglycine, cyclohexylalanine, β-alanine, a fluoro-amino acid, a 3-methyl amino acid, α-C-methyl amino acid, a N-methyl amino acid, 2-amino-isobutyric acid, β-homoglutamatic acid, β-homophenylalanine, β-homolysine, β-homoleucine, β-homoasparagine, β-homoglutamine, β-homoarginine, β-homoserine, β-homotyrosine, β-homoaspartic acid, β-homovaline, β-homoasparagin, (S)-cyclohexylalanine, (S)-citrullin, (S)-2,4-diaminobutyric acid, (S)-2,4-diaminobutyric acid, (S)-diaminopropionic acid, (S)-2-propargylglycine, (S)—N(omega)-nitro-arginine, L-homophenylalanine, S)-homo-arginine, (S)-homo-citrulline, (S)-homo-cysteine, (S)-2-amino-5-methyl-hexanoic acid, (S)-homo-lysine, (S)-norleucine, (S)—N-methylalanine, (S)—N-methyl-aspartic acid, (S)—N-methyl-glutamic acid, (S)—N-methyl-phenylalanine, N-methyl-glycine, (S)—N-methyl-lysine, (S)—N-methyl-leucine, (S)—N-methyl-arginine, (S)—N-methyl-serine, (S)—N-methyl-valine, (S)—N-methyl-tyrosine, (S)-2-amino-pentanoic acid, (S)-2-pyridyl-alanine, (S)-ornithine, L-phenylglycin, 4-phenyl-butyric acid and selenomethionine. The individual amino acids may have either L or D stereochemistry when appropriate, although the L stereochemistry is typically employed for all of the amino acids in the peptide.

The invention further includes TFPI-inhibitory peptide variants comprising one or more amino acids inserted within an amino acid sequence provided herein and/or attached to the N-terminus or C-terminus. In one aspect, the peptide further comprises one or more amino acids that facilitate synthesis, handling, or use of the peptide, including, but not limited to, one or two lysines at the N-terminus and/or C-terminus to increase solubility of the peptide. Suitable fusion proteins include, but are not limited to, proteins comprising a TFPI-inhibitory peptide linked to one or more polypeptides, polypeptide fragments, or amino acids not generally recognized to be part of the protein sequence. In one aspect, a fusion peptide comprises the entire amino acid sequences of two or more peptides or, alternatively, comprises portions (fragments) of two or more peptides. In addition to all or part of the TFPI-inhibitory peptides described herein, a fusion protein optionally includes all or part of any suitable peptide comprising a desired biological activity/function. Indeed, in some aspects, a TFPI-inhibitory peptide is operably linked to, for instance, one or more of the following: a peptide with long circulating half life, a marker protein, a peptide that facilitates purification of the TFPI-inhibitory peptide, a peptide sequence that promotes formation of multimeric proteins, or a fragment of any of the foregoing. In one embodiment, two or more TFPI-inhibitory peptides are fused together, linked by a multimerization domain, or attached via chemical linkage to generate a TFPI-inhibitory peptide complex. The TFPI-inhibitor peptides may be the same or different.

"Derivatives" are included in the invention and include TFPI-inhibitory peptides that have been chemically modified in some manner distinct from addition, deletion, or substitution of amino acids. In this regard, a peptide of the invention provided herein is chemically bonded with polymers, lipids, other organic moieties, and/or inorganic moieties. Examples of peptide and protein modifications are given in Hermanson, *Bioconjugate Techniques*, Academic Press, (1996). Derivatives are prepared in some situations to increase solubility, stability, absorption, or circulating half-life. Various chemical modifications eliminate or attenuate any undesirable side effect of the agent. In this regard, the invention includes TFPI-inhibitory peptides covalently modified to include one or more water soluble polymer attachments. Useful polymers known in the art include, but are not limited to, polyethylene glycol (PEG) (e.g., PEG approximately 40 kD or 1 kD in size), polyoxyethylene glycol, polypropylene glycol, monomethoxy-polyethylene glycol, dextran, cellulose, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of any of the foregoing. In one aspect, the peptide of the invention is a PEGylated peptide. For further discussion of water soluble polymer attachments, see U.S. Pat. Nos. 4,640,835; 4,496,689; 4,301,144; 4,670,417; 4,791,192; and 4,179,337. In another aspect, a peptide derivative includes a targeting moiety specific for a particular cell type, tissue, and/or organ. Alternatively, the peptide is linked to one or more chemical moieties that facilitate purification, detection, multimerization, and characterization of peptide activity. An exemplary chemical moiety is biotin. In addition, in one aspect, the peptides of the invention are acylated at the N-terminal amino acid of the peptide. In another aspect, the peptides of the invention are amidated at the C-terminal amino acid of the peptide. In a still further aspect, the peptides of the invention are acylated at the N-terminal amino acid of the peptide and are amidated at the C-terminal amino acid of the peptide.

Derivatives also include peptides comprising modified or non-proteinogenic amino acids or a modified linker group (see, e.g., Grant, *Synthetic Peptides: A User's Guide*, Oxford University Press (1992)). Modified amino acids include, for example, amino acids wherein the amino and/or carboxyl group is replaced by another group. Non-limiting examples include modified amino acids incorporating thioamides, ureas, thioureas, acylhydrazides, esters, olefines, sulfonamides, phosphoric acid amides, ketones, alcohols, boronic acid amides, benzodiazepines and other aromatic or non-aromatic heterocycles (see Estiarte et al., *Burgers Medicinal Chemistry,* 6th edition, Volume 1, Part 4, John Wiley & Sons, New York (2002)). Modified amino acids are often connected to the peptide with at least one of the above mentioned functional groups instead of an amide bond. Non-proteinogenic amino acids include, but are not limited, to β-alanine (Bal), norvaline (Nva), norleucine (Nle), 4-aminobutyric acid (γ-Abu), 2-aminoisobutyric acid (Aib), 6-aminohexanoic acid (ϵ-Ahx), ornithine (Orn), hydroxyproline (Hyp), taurine, sarcosine, citrulline (Cit), cysteic acid (Coh), cyclohexylalanine (Cha), methioninesulfoxide (Meo), methioninesulfone (Moo), homoserinemethylester (Hsm), propargylglycine (Eag), 5-fluorotryptophan (5Fw), 6-fluorotryptophan (6Fw), 3',4'-dimethoxyphenyl-alanine (Ear), 3',4'-difluorophenylalanine (Dff), 4'-fluorophenyl-alanine (Pff), 1-naphthyl-alanine (1Ni), 1-methyltryptophan (1Mw), penicillamine (Pen), homoserine (Hse), t-butylglycine, t-butylalanine, phenylglycine (Phg), benzothienylalanine (Bta), L-homo-cysteine (Hcy), N-methyl-phenylalanine (Nmf), 2-thienylalanine (Thi), 3,3-diphenylalanine (Ebw), homophenylalanine (Hfe) and S-benzyl-L-cysteine (Ece). These and other non-proteinogenic amino acids may exist as D- or L-isomers. Examples of modified linkers include, but are not limited to, the flexible linker 4,7,10-trioxa-1,13-tridecanediamine (Ttds), glycine, 6-aminohexanoic acid, beta-alanine (Bal), and combinations of Ttds, glycine, 6-aminohexanoic acid and Bal.

Homologues of the amino acids constituting the peptides of the invention may be as set forth in Table 3.

TABLE 3

| Amino Acid | Exemplary homologues |
|---|---|
| A | Aib, Bal, Eag, Nma, Abu, G, M, Nva, Nle |
| C | S, A, Hcy, M, L, I, V, Nmc, β-Cysteine |
| D | E, Homoglutamic acid, γ-Hydroxy-glutamic acid, γ-Carboxy-glutamic acid, Nmd, β-Aspartic acid, N, Q, Cysteic acid |
| E | D, Glu, Homoglutamic acid, γ-Hydroxy-glutamic acid, γ-Carboxy-glutamic acid, α-Aminoadipic acid, Nme, β-glutamic acid, Q, N, Cysteic acid |
| F | Hfe, Nmf, β-Phenylalanine, Phg, Bhf, Thienylalanine, Benzothienylalanine, Bromophenylalanine, Iodophenylalanione, Chlorophenylalanine, Methylphenylalanine, Nitrophenylalanine, Y, W, Naphtylalanine, Tic |
| G | A, Nmg |
| H | Nmh, 1-Methylhistidine, 3-Methylhistidine, Thienylalanine |
| I | L, V, Hle, Nva, Nle, β-Isoleucine, Nml, M, Nmi |
| K | Nmk, R, Nmr, β-Lysine, Dab, Dap, β-(1-Piperazinyl)-alanine, 2,6-Diamino-4-hexynoic acid, delta-Hydroxy-lysine, Har, omega-Hydroxy-norarginine, omega-Amino-arginine, omega-Methyl-arginine, β-(2-Pyridyl)-alanine, β-(3-Pyridyl)-alanine, 3-Amino-tyrosine, 4-Amino-phenylalanine, Hci, Cit |
| L | I, V, Hle, Nle, Nva, β-Isoleucine, Nml, M |
| M | I, V, Hle, Nva, R, Har, Nmm, Methioninesulfone |
| N | Nmn, β-Asparagine, Q, Nmq, β-Glutamine, Cys(3-propionic acid amide)-OH, Cys(O2-3-propionic acid amide)-OH |
| P | Azetidine-2-carboxylic acid, Hyp, α-Methyl-methionine, 4-Hydroxy-piperidine-2-carboxylic acid, Pip, α-Methyl-Pro |
| Q | N, Nmn, Nmq, β-Glutamine, Cys(3-propionic acid amide)-OH, Cys(O2-3-propionic acid amide)-OH |
| R | Nmk, K, Nmr, β-Lysine, Dab, Dap, Orn, β-(1-Piperazinyl)-alanine, 2,6-Diamino-4-hexynoic acid, delta-Hydroxy-lysine, Har, omega-Hydroxy-norarginine, omega-Amino-arginine, omega-Methyl-arginine, β-(2-Pyridyl)-alanine, β-(3-Pyridyl)-alanine, 3-Amino-tyrosine, 4-Amino-phenylalanine, Hci, Cit, Hle, L, Nle, M |
| S | T, Hse, β-Serine, C, β-Cyano-alanine, allo-Threonine |
| T | S, Homothreonine, β-Threonine, allo-Threonine |
| V | L, I, Hle, Nva, Nle, β-Valine, Nmv, M, Nmi, Nml |
| W | Nmw, β-Tryptophan, F, Hfe, Nmf, β-Phenylalanine, Phg, Bhf, Thienylalanine, Benzothienylalanine, Bromophenylalanine, Iodophenylalanine, Chlorophenylalanine, Methylphenylalanine, Nitrophenylalanine, Y, Naphtylalanine, Tic |
| Y | Nmy, β-Tyrosine,, F, Hfe, Nmf, β-Phenylalanine, Phg, Bhf, Thienylalanine, Benzothienylalanine, Bromophenylalanine, Iodophenylalanine, Chlorophenylalanine, Methylphenylalanine, Nitrophenylalanine, W, Naphtylalanine, Tic |

In some embodiments, the peptide (CO—NH) linkages joining amino acids within the peptide of the invention are reversed to create a "retro-modified" peptide, i.e., a peptide comprising amino acid residues assembled in the opposite direction (NH—CO bonds) compared to the reference peptide. The retro-modified peptide comprises the same amino acid chirality as the reference peptide. An "inverso-modified" peptide is a peptide of the invention comprising amino acid residues assembled in the same direction as a reference peptide, but the chirality of the amino acids is inverted. Thus, where the reference peptide comprises L-amino acids, the "inverso-modified" peptide comprises D-amino acids, and vice versa. Inverso-modified peptides comprise CO—NH peptide bonds. A "retro-inverso modified" peptide refers to a peptide comprising amino acid residues assembled in the opposite direction and which have inverted chirality. A retro-inverso analogue has reversed termini and reversed direction of peptide bonds (i.e., NH—CO), while approximately maintaining the side chain topology found in the reference peptide. Retro-inverso peptidomimetics are made using standard methods, including the methods described in Meziere et al, *J. Immunol.,* 159, 3230-3237 (1997), incorporated herein by reference. Partial retro-inverso peptides are peptides in which only part of the amino acid sequence is reversed and replaced with enantiomeric amino acid residues.

TFPI-binding peptides of the invention (e.g., TFPI inhibitor peptides) are made in a variety of ways. In one aspect, the peptides are synthesized by solid phase synthesis techniques including those described in Merrifield, *J. Am. Chem. Soc.,* 85, 2149 (1963); Davis et al., *Biochem. Intl.,* 10, 394-414 (1985); Larsen et al., *J. Am. Chem. Soc.,* 115, 6247 (1993); Smith et al., *J. Peptide Protein Res.,* 44, 183 (1994); O'Donnell et al., *J. Am. Chem. Soc.,* 118, 6070 (1996); Stewart and Young, *Solid Phase Peptide Synthesis*, Freeman (1969); Finn et al., *The Proteins,* 3rd ed., vol. 2, pp. 105-253 (1976); and Erickson et al., *The Proteins,* 3rd ed., vol. 2, pp. 257-527 (1976). Alternatively, the TFPI-binding peptide (e.g., the TFPI-inhibitory peptide) is expressed recombinantly by introducing a nucleic acid encoding a TFPI-binding peptide (e.g., a TFPI-inhibitory peptide) into host cells, which are cultured to express the peptide. Such peptides are purified from the cell culture using standard protein purification techniques.

The invention also encompasses a nucleic acid comprising a nucleic acid sequence encoding a TFPI-inhibitory peptide of the invention. Methods of preparing DNA and/or RNA molecules are well known in the art. In one aspect, a DNA/RNA molecule encoding a peptide provided herein is generated using chemical synthesis techniques and/or using polymerase chain reaction (PCR). If desired, a TFPI-inhibitory peptide coding sequence is incorporated into an expression vector. One of ordinary skill in the art will appreciate that any of a number of expression vectors known in the art are suitable in the context of the invention, such as, but not limited to, plasmids, plasmid-liposome complexes, and viral vectors. Any of these expression vectors are prepared using standard recombinant DNA techniques described in, e.g., Sambrook et al., *Molecular Cloning, a Laboratory Manual,* 2d edition, Cold Spring Harbor Press, Cold Spring Harbor, N.Y. (1989), and Ausubel et al., *Current Protocols in Molecular Biology*, Greene Publishing Associates and John Wiley & Sons, New York, N.Y. (1994). Optionally, the nucleic acid is operably linked to one or more regulatory sequences, such as a promoter, activator, enhancer, cap signal, polyadenylation signal, or other signal involved with the control of transcription or translation.

Any of the TFPI-inhibitory peptides of the invention or nucleic acids encoding the peptides also is provided in a composition (e.g., a pharmaceutical composition). In this regard, the peptide is formulated with a physiologically-acceptable (i.e., pharmacologically-acceptable) carrier, buffer, excipient, or diluent, as described further herein. Optionally, the peptide is in the form of a physiologically acceptable salt, which is encompassed by the invention. "Physiologically acceptable salts" means any salts that are pharmaceutically acceptable. Some examples of appropriate salts include acetate, hydrochloride, hydrobromide, sulfate, citrate, tartrate, glycolate, and oxalate. If desired, the composition comprises one or more additional pharmaceutically-effective agents.

The peptide provided herein optionally inhibits at least one Tissue Factor Pathway Inhibitor-1 (e.g., TFPI-1α) activity such as, but not limited to, an activity that down-regulates the blood coagulation cascade. Without being bound by any specific mechanism of action, a proposed mechanism of inhibition may involve preventing formation of the quaternary TF-FVIIA-FXA-TFPI complex. The peptide may inhibit binding of TFPI to FXa (e.g., inhibit binding of TFPI Kunitz domain 2 to Factor Xa), the TF/FVIIa complex (e.g., inhibit binding of TFPI Kunitz domain 1 to the TF/FVIIa complex), TF alone, and/or FVIIa alone. With TFPI activity diminished, TF and FVIIa are free to activate FX which, in turn, enhances conversion of prothrombin to thrombin.

In one aspect, the peptide of the invention exhibits TFPI antagonistic activity in model and/or plasmatic systems. An exemplary model system for determining TFPI-inhibitory activity is the extrinsic tenase assay, which tests the ability of candidate peptides to restore extrinsic complex-mediated FX activation in the presence of TFPI (which is a natural inhibitor of the FX activation reaction) (see, e.g., Lindhout et al., *Thromb. Haemost.*, 74, 910-915 (1995)). Another model system for characterizing TFPI-inhibitory activity is the FXa inhibition assay, wherein FXa activity is measured in the presence of TFPI (see Sprecher et al., *PNAS*, 91, 3353-3357 (1994)). The extrinsic tenase assay and the FXa inhibition assay are further described in Example 3. Optionally, the peptide of the invention enhances FX activation in the presence of TFPI with a half maximal effective concentration ($EC_{50}$) of less than or equal to $1\times10^{-4}$ M, less than or equal to $1\times10^{-5}$ M, less than or equal to $1\times10^{-6}$ M, or less than or equal to $1\times10^{-7}$ M.

In one aspect, TFPI-antagonist activity is characterized in a plasma-based assay. Thrombin formation is triggered in plasma substantially lacking FVIII or FIX activity (e.g., the residual coagulation factor activity is lower than 1%) in the presence of a candidate peptide. Thrombin formation can be detected using a fluorogenic or chromogenic substrate, as described in Example 4. A system for measuring thrombin activity is provided by Thrombinoscope BV (Maastricht, The Netherlands). Prothrombin conversion is measured using, e.g., a Thrombograph™ (Thermo Scientific, Waltham, Mass.), and the resulting data is compiled into a Calibrated Automatic Thrombogram generated by Thrombinoscope™ software available from Thrombinoscope BV. In certain embodiments, the TFPI-inhibitory peptide increases the amount of peak thrombin generated during the assay and/or decreases the time required to achieve peak thrombin formation. For example, the peptide improves TFPI-regulated thrombin generation in the absence of FVIII (e.g., in FVIII-depleted plasma) to at least 1% of the level of TFPI-dependent thrombin generation in normal plasma. Generally, normal (unafflicted) plasma contains about 0.5 U/mL to about 2 U/mL Factor VIII. Accordingly, in some instances, a TFPI-inhibitor peptide will enhance thrombin formation in the absence of FVIII to at least about 1% of that observed in the presence of 0.5 U/mL to 2 U/mL FVIII. In further embodiments, the peptide enhances thrombin formation in the absence of Factor VIII to at least about 2%, at least about 3%, at least about 5%, at least about 7%, or at least about 10% of the level of thrombin formation in normal plasma, i.e., in the presence of physiological levels of Factor VIII. In various aspects, the peptide is administered to an animal model of thrombin deficiency or hemophilia to characterize TFPI inhibitory activity in vivo. Such in vivo models are known in the art and include for example, mice administered anti-FVIII antibodies to induce hemophilia A (Tranholm et al., *Blood,* 102, 3615-3620 (2003)); coagulation factor knock-out models such as, but not limited to, FVIII knock-out mice (Bi et al., *Nat. Genet.,* 10(1), 119-121 (1995)) and FIX knock-out mice (Wang et al., *PNAS,* 94(21), 11563-66 (1997)); induced hemophilia-A in rabbits (Shen et al., *Blood,* 42(4), 509-521 (1973)); and Chapel Hill HA dogs (Lozier et al., *PNAS,* 99, 12991-12996 (2002)).

While not being bound to any particular theory or mechanism, the peptide of the invention provided herein may inhibit TFPI activity by blocking (competitively or allosterically) binding of TFPI and FXa. Alternatively or in addition, the peptide may inhibit binding of TFPI with a Tissue Factor (TF)/Factor VIIa complex. Thus, in certain aspects, the peptide specifically binds TFPI. Various peptides bind TFPI from any source including, but not limited to, mouse, rat, rabbit, dog, cat, cow, horse, pig, guinea pig, and primate. In one embodiment, the peptide binds human TFPI. Optionally, the TFPI-inhibitory peptide binds TFPI from more than one species (i.e., the peptide is cross-reactive among multiple species). In certain aspects, the peptide binds TFPI with a dissociation constant ($K_D$) of less than or equal to $1\times10^{-4}$ M, less than or equal to $1\times10^{-5}$ M, less than or equal to $1\times10^{-6}$ M, or less than or equal to $1\times10^{-7}$ M. Affinity may be determined using, for example and without limitation, any one, two, or more of a variety of techniques, such as affinity ELISA assay, a competitive ELISA assay, and/or surface plasmon resonance (BIAcore™) assay. When characterized using a competitive ($IC_{50}$) ELISA assay, the peptide of the invention optionally demonstrates an $IC_{50}$ of less than or equal to about 50,000 nM. For example, the peptide demonstrates an $IC_{50}$ of less than or equal to about 10,000 nM, such as an $IC_{50}$ of less than or equal to about 5,000 nM, less than or equal to about 1,000 nM, or less than or equal to about 500 nM. In one aspect, the peptide demonstrates an $IC_{50}$ of less than or equal to about 250 nM, less than or equal to about 100 nM, or less than or equal to about 50 nM. Exemplary peptides and their $IC_{50}$ values are provided in FIGS. 32-39; in some instances, the peptides are classified into Groups A, B, C, D, E, F, and G (see Table 4 in Example 1) based on their $IC_{50}$ values. In various aspects, the invention provides peptides falling within Groups A, B, C, D, E, F, and/or G as defined in Table 4. Affinity may also be determined by a kinetic method or an equilibrium/solution method. Such methods are described in further detail herein or known in the art.

As with all binding agents and binding assays, one of skill in the art recognizes that the various moieties to which a binding agent should not detectably bind in order to be biologically (e.g., therapeutically) effective would be exhaustive and impractical to list. Therefore, the term "specifically binds" refers to the ability of a peptide to bind TFPI with greater affinity than it binds to an unrelated control protein that is not TFPI. For example, the peptide may bind to TFPI with an affinity that is at least, 5, 10, 15, 25, 50, 100, 250, 500, 1000, or 10,000 times greater than the affinity for a control protein. In some embodiments, the peptide binds TFPI with greater affinity than it binds to an "anti-target," a protein or other naturally occurring substance in humans to which binding of the peptide might lead to adverse effects. Several classes of peptides or proteins are potential anti-targets. Because TFPI-inhibitory peptides exert their activity in the blood stream and/or at the endothelium, plasma proteins represent potential anti-targets. Proteins containing Kunitz domains (KDs) are potential anti-targets because KDs of different proteins share a significant similarity. Tissue Factor Pathway Inhibitor-2 (TFPI-2) is highly similar to TFPI-1α and, like TFPI-1α, contains KDs (Sprecher et al., *PNAS,* 91, 3353-3357 (1994)). Thus, in one aspect, the peptide of the invention binds to TFPI with an affinity that is at least 5, 10, 15, 25, or 50 times greater than the affinity for an anti-target, such as TFPI-2.

The invention further includes a method of inhibiting Tissue Factor Pathway Inhibitor-1 (TFPI). The method comprises contacting TFPI with a TFPI-binding peptide as described herein. Any degree of TFPI-activity inhibition is contemplated. For example, a TFPI-inhibitory peptide reduces TFPI-inhibition of the extrinsic pathway at least about 5% (e.g., at least about 10%, at least about 25%, or at least about 30%). In some embodiments, the TFPI-inhibitory peptide reduces TFPI activity within the extrinsic pathway at least about 50%, at least about 75%, or at least about 90% compared to TFPI activity in the absence of the peptide.

The invention further includes a method for targeting biological structures (including, but not limited to, cell surfaces and endothelial lining) where TFPI is located. The method comprises contacting the biological structure (e.g., including, without limitation, a cell displaying TFPI on the cell surface) with a TFPI-binding peptide described herein, optionally conjugated to a moiety that adds additional functionality to the peptide. The moiety can be a dye (such as a fluorescence dye), a radionuclide or a radionuclide-containing complex, a protein (e.g., an enzyme, a toxin, or an antibody) or a cytotoxic agent. For example, the peptide is linked or conjugated to an effector moiety that facilitates peptide detection and/or purification and/or comprises therapeutic properties. In one aspect, the TFPI-binding peptide or peptide conjugate is administered to a mammal to target a TFPI-displaying cell within the mammal. Optionally, the method further comprises detecting binding of the TFPI-binding peptide to TFPI. The method is useful for therapy and diagnostic of disease where TFPI is a suitable diagnostic marker or TFPI-expressing cells are a target for a therapeutic approach.

In some aspects, peptide-TFPI binding is detected indirectly. In this regard, the peptide is contacted with an interaction partner that binds the peptide of invention without significantly interfering with peptide-TFPI binding, and the interaction partner is detected. Exemplary interaction partners include, but are not limited to, antibodies, antigen-binding antibody fragments, anticalins and antibody mimetics, aptamers, and spiegelmers. Optionally, the interaction partner comprises a detection moiety to facilitate detection of an interaction partner-peptide complex. Methods of detecting, e.g., antibodies and fragments thereof, are well understood in the art. Similarly, detection moieties are widely used in the art to identify biological substances and include, for example, dye (e.g., fluorescent dye), radionuclides and radionuclide-containing complexes, and enzymes.

Thus, the invention provides a method for diagnosing a subject suffering from a disease or disorder, or at risk of suffering from a disease or disorder, wherein the disease or disorder is associated with or caused by aberrant TFPI activity. The method comprises administering to the subject the TFPI-binding peptide of the invention and detecting the TFPI-peptide complex. In some instances, the peptide of the invention is conjugated to a detectable moiety, and the method comprises detecting the detectable moiety. In other instances, the method comprises administering to the subject a TFPI-binding peptide interaction partner that binds the TFPI-binding peptide, and detecting the interaction partner. If desired, the interaction partner comprises or is conjugated to a detectable moiety, and the detectable moiety is detected. The presence of the detectable moiety indicates the presence of TFPI, thereby allowing diagnosis of a disease or disorder associated with TFPI (e.g., a disease or disorder which (i) can be treated by inhibiting TFPI or (ii) comprises symptoms which can be ameliorated or prevented by inhibiting TFPI). If administration of the peptide to the subject is not desired, a biological sample is obtained from the subject, contacted with the TFPI-binding peptide as described herein, and TFPI-peptide complexes are detected.

The peptides of the invention bind TFPI and, therefore, are useful for purifying TFPI or recombinant TFPI from a biological sample (e.g., a biological fluid, such as serum), fermentation extract, tissue preparations, culture medium, and the like. The invention includes methods of using the TFPI-binding in the commercial production of TFPI or in a method of characterizing TFPI molecules. For example, the invention includes a method of purifying TFPI. The method comprises contacting a sample containing TFPI with a peptide as defined herein under conditions appropriate to form a complex between TFPI and the peptide; removing the complex from the sample; and, optionally, dissociating the complex to release TFPI. Exemplary conditions appropriate to form a complex between TFPI and the peptide are disclosed in the Examples, and such conditions can be easily modified to dissociate the TFPI-peptide complex. In some embodiments, the peptide is immobilized to a support, e.g., a solid support, to facilitate recovery of TFPI. For example, in one embodiment, the peptide is immobilized to chromatography stationary phase (e.g., silica, affinity chromatography beads, or chromatography resins), a sample comprising TFPI is applied to the stationary phase such that TFPI-peptide complexes are formed, the remainder of the sample is removed from the stationary phase, and TFPI is eluted from the stationary phase. In this regard, the peptides of the invention are, in one aspect, suitable for use in affinity chromatography techniques.

A method of enhancing thrombin formation in a clotting factor-deficient subject also is provided. The method comprises administering to the subject a peptide provided herein under conditions effective to inhibit TFPI. In this regard, the TFPI-inhibitory peptide is administered in an amount and under conditions effective to enhance thrombin formation in the subject. By “clotting factor-deficient” is meant that the subject suffers from a deficiency in one or more blood factors required for thrombin formation, such as FVIII, FIX, or FXI. Indeed, in one embodiment, the subject is deficient in FVIII. Alternatively or in addition, the subject is deficient in Factor IX. Clotting factor deficiencies are identified by examining the amount of factor in a clinical sample. Practitioners classify hemophilia according to the magnitude of clotting factor deficiency. Subjects suffering from mild hemophilia have approximately 5% to 30% of the normal amount (1 U/ml) of Factor VIII or Factor IX. Moderate hemophilia is characterized by approximately 1% to 5% of normal Factor VIII, Factor IX, or Factor XI levels, while subjects suffering from severe hemophilia have less than 1% of the normal amount of Factor VIII, Factor IX, or Factor XI. Deficiencies can be identified indirectly by activated partial thromboplastin time (APTT) testing. APTT testing measures the length of time required for a blood clot to form, which is longer for patients with Factor VIII Deficiency (hemophilia A), Factor IX Deficiency (hemophilia B), and Factor XI Deficiency (hemophilia C) compared to patients with normal clotting factor levels. Almost 100% of patients with severe and moderate Factor VIII deficiency can be diagnosed with an APTT. The invention further includes enhancing thrombin formation in a subject that does not suffer from a clotting factor deficiency. The method comprises administering to a subject (e.g., a subject comprising normal, physiological levels of clotting factor) a peptide provided herein under conditions effective to enhance thrombin formation.

In one aspect, the TFPI-inhibitory peptide is used for increasing blood clot formation in a subject. The method of increasing blood clot formation comprises administering to the subject a peptide described herein in an amount and under conditions effective to increase blood clot formation. It will be appreciated that the method need not completely restore the coagulation cascade to achieve a beneficial (e.g., therapeutic) effect. Any enhancement or increase in thrombin or blood clot formation that reduces the onset or severity of symptoms associated with clotting factor deficiencies is contemplated. Methods of determining the efficacy of the method in promoting thrombin formation and blood clotting are known in the art and described herein.

The invention further includes a method of treating a blood coagulation disorder in a subject, the method comprising administering to the subject one or more TFPI-inhibitory peptides, such as any one or more of the peptides described herein, in an amount and under conditions effective to treat the blood coagulation disorder in the subject. In one aspect, the peptide is not a naturally-occurring peptide that inhibits TFPI activity. “Coagulation disorders” include bleeding disorders caused by deficient blood coagulation factor activity and deficient platelet activity. Blood coagulation factors include, but are not limited to, Factor V (FV), FVII, FVIII, FIX, FX, FXI, FXIII, FII (responsible for hypoprothrombinemia), and von Willebrand’s factor. Factor deficiencies are caused by, for instance, a shortened in vivo-half-life of the factor, altered binding properties of the factor, genetic defects of the factor, and a reduced plasma concentration of the factor. Coagulation disorders can be congenital or acquired. Potential genetic defects include deletions, additions and/or substitution within a nucleotide sequence encoding a clotting factor whose absence, presence, and/or substitution, respectively, has a negative impact on the clotting factor’s activity. Coagulation disorders also stem from development of inhibitors or autoimmunity (e.g., antibodies) against clotting factors. In one example, the coagulation disorder is hemophilia A. Alternatively, the coagulation disorder is hemophilia B or hemophilia C.

Platelet disorders are caused by deficient platelet function or abnormally low platelet number in circulation. Low platelet count may be due to, for instance, underproduction, platelet sequestration, or uncontrolled patent destruction. Thrombocytopenia (platelet deficiencies) may be present for various reasons, including chemotherapy and other drug therapy, radiation therapy, surgery, accidental blood loss, and other disease conditions. Exemplary disease conditions that involve thrombocytopenia are: aplastic anemia; idiopathic or immune thrombocytopenia (ITP), including idiopathic thrombocytopenic purpura associated with breast cancer; HIV-associated ITP and HIV-related thrombotic thrombocytopenic purpura; metastatic tumors which result in thrombocytopenia; systemic lupus erythematosus, including neonatal lupus syndrome splenomegaly; Fanconi’s syndrome; vitamin B12 deficiency; folic acid deficiency; May-Hegglin anomaly; Wiskott-Aldrich syndrome; chronic liver disease; myelodysplastic syndrome associated with thrombocytopenia; paroxysmal nocturnal hemoglobinuria; acute profound thrombocytopenia following C7E3 Fab (Abciximab) therapy; alloimmune thrombocytopenia, including maternal alloimmune thrombocytopenia; thrombocytopenia associated with antiphospholipid antibodies and thrombosis; autoimmune thrombocytopenia; drug-induced immune thrombocytopenia, including carboplatin-induced thrombocytopenia and heparin-induced thrombocytopenia; fetal thrombocytopenia; gestational thrombocytopenia; Hughes’ syndrome; lupoid thrombocytopenia; accidental and/or massive blood loss; myeloproliferative disorders; thrombocytopenia in patients with malignancies; thrombotic thrombocytopenia purpura, including thrombotic microangiopathy manifesting as thrombotic thrombocytopenic purpura/hemolytic uremic syndrome in cancer patients; post-transfusion purpura (PTP); autoimmune hemolytic anemia; occult jejunal diverticulum perforation; pure red cell aplasia; autoimmune thrombocytopenia; nephropathia epidemica; rifampicin-associated acute renal failure; Paris-Trousseau thrombocytopenia; neonatal alloimmune thrombocytopenia; paroxysmal nocturnal hemoglobinuria; hematologic changes in stomach cancer; hemolytic uremic syndromes (e.g., uremic conditions in childhood); and hematologic manifestations related to viral infection including hepatitis A virus and CMV-associated thrombocytopenia. Platelet disorders also include, but are not limited to, Von Willebrand Disease, paraneoplastic platelet dysfunction, Glanzman’s thrombasthenia, and Bernard-Soulier disease. Additional bleeding disorders amenable to treatment with a TFPI-inhibitory peptide include, but are not limited to, hemorrhagic conditions induced by trauma; a deficiency in one or more contact factors, such as FXI, FXII, prekallikrein, and high molecular weight kininogen (HMWK); vitamin K deficiency; a fibrinogen disorder, including afibrinogenemia, hypofibrinogenemia, and dysfibrinogenemia; and alpha2-antiplasmin deficiency. In one embodiment, the TFPI-inhibitory peptide is used to treat excessive bleeding, such as excessive bleeding caused by surgery, trauma, intracerebral hemorrhage, liver disease, renal disease, thrombocytopenia, platelet dysfunction, hematomas, internal hemorrhage, hemarthroses, hypothermia, menstruation, pregnancy, and Dengue hemorrhagic fever. All of the above are considered “blood coagulation disorders” in the context of the disclosure.

In one aspect, the TFPI-inhibitory peptide of the invention is used to reverse the effects (in whole or in part) of one or more anticoagulants in a subject. Numerous anticoagulants are known in the art and include, for instance, heparin; coumarin derivatives, such as warfarin or dicumarol; TFPI; AT III; lupus anticoagulant; nematode anticoagulant peptide (NAPc2); FVIIa inhibitors; active-site blocked FVIIa (FVIIai); active-site blocked FIXa (FIXai); FIXa inhibitors; FXa inhibitors, including fondaparinux, idraparinux, DX-9065a, and razaxaban (DPC906); active-site blocked FXa (FXai); inhibitors of FVa or FVIIIa, including activated protein C (APC) and soluble thrombomodulin; thrombin inhibitors, including hirudin, bivalirudin, argatroban, and ximelagatran; and antibodies or antibody fragments that bind a clotting factor (e.g., FV, FVII, FVIII, FIX, FX, FXIII, FII, FXI, FXII, von Willebrand factor, prekallikrein, or high molecular weight kininogen (HMWK)).

As used herein, “treating” and “treatment” refers to any reduction in the severity and/or onset of symptoms associated with a blood coagulation disorder. Accordingly, “treating” and “treatment” includes therapeutic and prophylactic measures. One of ordinary skill in the art will appreciate that any degree of protection from, or amelioration of, a blood coagulation disorder or symptom associated therewith is beneficial to a subject, such as a human patient. The quality of life of a patient is improved by reducing to any degree the severity of symptoms in a subject and/or delaying the appearance of symptoms. Accordingly, the method in one aspect is performed as soon as possible after it has been determined that a subject is at risk for developing a blood coagulation disorder (e.g., a deficiency in a clotting factor (e.g., FVIII, FIX, or FXI) is detected) or as soon as possible after a blood coagulation disorder (e.g., hemophilia A, hemophilia B, or hemophilia C) is detected. In an additional aspect, the peptide is administered to protect, in whole or in part, against excessive blood loss during injury or surgery.

In view of the above, the invention provides a peptide for use in a method for the treatment of a subject, such as a method for the treatment of a disease where the inhibition of TFPI is beneficial. In one aspect, the disease or disorder is a blood coagulation disorder. The subject is suffering from a disease or disorder or is at risk from suffering from a disease or disorder (or adverse biological event, such as excessive blood loss). The method comprises administering to the subject the peptide of the invention in an amount and under conditions effective to treat or prevent, in whole or in part, the disease or disorder. The invention further provides a peptide for use in the manufacture of a medicament. For example, the peptide can be used in the manufacture of a medicament for the treatment of a blood coagulation disorder, as described in detail herein.

In some embodiments, it is advantageous to administer to a subject a nucleic acid comprising a nucleic acid sequence encoding a TFPI-binding peptide (e.g., TFPI-inhibitory peptide) of the invention. Such a nucleic acid, in one aspect, is provided instead of, or in addition to, a TFPI-inhibitory peptide. Expression vectors, nucleic acid regulatory sequences, administration methods, and the like, are further described herein and in U.S. Patent Publication No. 20030045498.

A particular administration regimen for a particular subject will depend, in part, upon the TFPI-inhibitory peptide of the invention used, the amount of TFPI-binding peptide (e.g., TFPI-inhibitory peptide) administered, the route of administration, the particular ailment being treated, considerations relevant to the recipient, and the cause and extent of any side effects. The amount of peptide administered to a subject (e.g., a mammal, such as a human) and the conditions of administration (e.g., timing of administration, route of administration, dosage regimen) are sufficient to effect the desired biological response over a reasonable time frame. Dosage typically depends upon a variety of factors, including the particular TFPI-inhibitory peptide employed, the age and body weight of the subject, as well as the existence and severity of any disease or disorder in the subject. The size of the dose also will be determined by the route, timing, and frequency of administration. Accordingly, the clinician may titer the dosage and modify the route of administration to obtain the optimal therapeutic effect, and conventional range-finding techniques are known to those of ordinary skill in the art. Purely by way of illustration, in one aspect, the method comprises administering, e.g., from about 0.1 μg/kg to about 100 mg/kg or more, depending on the factors mentioned above. In other embodiments, the dosage may range from 1 μg/kg up to about 75 mg/kg; or 5 μg/kg up to about 50 mg/kg; or 10 μg/kg up to about 20 mg/kg. In certain embodiments, the dose comprises about 0.5 mg/kg to about 20 mg/kg (e.g., about 1 mg/kg, 1.5 mg/kg, 2 mg/kg, 2.3 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 8 mg/kg, 9 mg/kg, or 10 mg/kg) of peptide. Given the chronic nature of many blood coagulation disorders, it is envisioned that a subject will receive the TFPI-inhibitory peptide over a treatment course lasting weeks, months, or years, and may require one or more doses daily or weekly. In other embodiments, the TFPI-inhibitory peptide is administered to treat an acute condition (e.g., bleeding caused by surgery or trauma, or factor inhibitor/autoimmune episodes in subjects receiving coagulation replacement therapy) for a relatively short treatment period, e.g., one to 14 days.

Suitable methods of administering a physiologically-acceptable composition, such as a pharmaceutical composition comprising a peptide described herein, are well known in the art. Although more than one route can be used to administer a peptide, a particular route can provide a more immediate and more effective reaction than another route. Depending on the circumstances, a pharmaceutical composition is applied or instilled into body cavities, absorbed through the skin or mucous membranes, ingested, inhaled, and/or introduced into circulation. In one aspect, a composition comprising a TFPI-inhibitory peptide is administered intravenously, intraarterially, or intraperitoneally to introduce the peptide of the invention into circulation. Non-intravenous administration also is appropriate, particularly with respect to low molecular weight therapeutics. In certain circumstances, it is desirable to deliver a pharmaceutical composition comprising the TFPI-inhibitory peptide orally, topically, sublingually, vaginally, rectally; through injection by intracerebral (intraparenchymal), intracerebroventricular, intramuscular, intraocular, intraportal, intralesional, intramedullary, intrathecal, intraventricular, transdermal, subcutaneous, intranasal, urethral, or enteral means; by sustained release systems; or by implantation devices. If desired, the TFPI-inhibitory peptide is administered regionally via intraarterial or intravenous administration feeding a region of interest, e.g., via the femoral artery for delivery to the leg. In one embodiment, the peptide is incorporated into a microparticle as described in, for example, U.S. Pat. Nos. 5,439,686 and 5,498,421, and U.S. Patent Publications 2003/0059474, 2003/0064033, 2004/0043077, 2005/0048127, 2005/0170005, 2005/0142205, 2005/142201, 2005/0233945, 2005/0147689. 2005/0142206, 2006/0024379, 2006/0260777, 2007/0207210, 2007/0092452, 2007/0281031, and 2008/0026068. Alternatively, the composition is administered via implantation of a membrane, sponge, or another appropriate material on to which the desired molecule has been absorbed or encapsulated. Where an implantation device is used, the device in one aspect is implanted into any suitable tissue, and delivery of the desired molecule is in various aspects via diffusion, timed-release bolus, or continuous administration. In other aspects, the TFPI-inhibitory peptide is administered directly to exposed tissue during surgical procedures or treatment of injury, or is administered via transfusion of blood procedures. Therapeutic delivery approaches are well known to the skilled artisan, some of which are further described, for example, in U.S. Pat. No. 5,399,363.

To facilitate administration, the TFPI-binding peptide (e.g., TFPI-inhibitory peptide) in one embodiment is formulated into a physiologically-acceptable composition comprising a carrier (i.e., vehicle, adjuvant, buffer, or diluent). The particular carrier employed is limited only by chemico-physical considerations, such as solubility and lack of reactivity with the peptide, and by the route of administration. Physiologically-acceptable carriers are well known in the art. Illustrative pharmaceutical forms suitable for injectable use include without limitation sterile aqueous solutions or dispersions and sterile powders for the extemporaneous preparation of sterile injectable solutions or dispersions (for example, see U.S. Pat. No. 5,466,468). Injectable formulations are further described in, e.g., Pharmaceutics and Pharmacy Practice, J. B. Lippincott Co., Philadelphia. Pa., Banker and Chalmers. eds., pages 238-250 (1982), and ASHP Handbook on Injectable Drugs, Toissel, 4th ed., pages 622-630 (1986)). A pharmaceutical composition comprising a peptide provided herein is optionally placed within containers, along with packaging material that provides instructions regarding the use of such pharmaceutical compositions. Generally, such instructions include a tangible expression describing the reagent concentration, as well as, in certain embodiments, relative amounts of excipient ingredients or diluents that may be necessary to reconstitute the pharmaceutical composition.

When appropriate, the TFPI-binding peptide (e.g., TFPI-inhibitory peptide) of the invention is administered in combination with other substances and/or other therapeutic modalities to achieve an additional or augmented biological effect. Co-treatments include, but are not limited to, plasma-derived or recombinant coagulation factors, hemophilia prophylaxis treatments, immunosuppressants, plasma factor-inhibiting antibody antagonists (i.e., anti-inhibitors), antifibrinolytics, antibiotics, hormone therapy, anti-inflammatory agents (e.g., Non-Steroidal Anti-Inflammatory Drugs (NSAIDs) or steroidal anti-inflammatory substances), procoagulants, and pain relievers. In one aspect, the method is an adjunct therapy to traditional replacement factor treatment regimens involving administration of, e.g., FXIII, FXII, FXI (e.g., HEMOLEVEN® (Laboratoire francais du Fractionnement et des Biotechnologies, Les Ulis, France) and FXI concentrate (BioProducts Laboratory, Elstree, Hertfordshire, UK)), FX, FIX (e.g., BENEFIX® Coagulation Factor IX (Wyeth, Madison, N.J.); ALPHANINE® SD (Grifols, Los Angeles, Calif.); MONONINE® (CSL Behring, King of Prussia, Pa.); BEBULIN-VH™ (Baxter, Deerfield, Ill.); PROFILNINE® SD (Grifols, Los Angeles, Calif.); or PROPLEX T™ (Baxter, Deerfield, Ill.)), FVIII (e.g., ADVATE™ (Baxter, Deerfield, Ill.); HELIXATE® FS(CSL Behring, King of Prussia, Pa.); REFACTO® (Wyeth, Madison, N.J.), XYNTHA™ (Wyeth, Madison, N.J.), KOGENATE® and KOGENATE® FS (Bayer, Pittsburgh, Pa.); ALPHANATE® (Grifols, Los Angeles, Calif.); HEMOPHIL M™ (Baxter, Deerfield, Ill.); KOATE®-DVI (Talecris Biotherapeutics-USA, Research Triangle Park, N.C.); or MONARC-M™ (Baxter, Deerfield, Ill.)), FVIIa (e.g., NOVOSEVEN® FVIIa (Novo Nordisk, Princeton, N.J.) and FVII concentrate (Baxter Bioscience, Vienna, Austria, or BioProducts Laboratory, Elstree, Hertfordshire, UK)), FV, FVa, FII, and/or FIII, to a subject. In some instances, the subject also receives FEIBA VH Immuno™ (Baxter BioScience, Vienna, Austria), which is a freeze-dried sterile human plasma fraction with Factor VIII inhibitor bypassing activity. FEIBA VH Immuno™ contains approximately equal units of Factor VIII inhibitor bypassing activity and Prothrombin Complex Factors (Factors II, VII, IX, and X and protein C). Other exemplary co-treatments include, but are not limited to, prekallikrein, high molecular weight kininogen (HMWK), Von Willebrand's factor, Tissue Factor, and thrombin. Alternatively or in addition, the TFPI-inhibitory peptide is co-formulated with one or more different TFPI-inhibitory peptides.

The invention thus includes administering to a subject a TFPI-binding peptide (e.g., TFPI-inhibitory peptide) of the invention (or multiple TFPI-inhibitory peptides), in combination with one or more additionally suitable substances(s), each being administered according to a regimen suitable for that medicament. Administration strategies include concurrent administration (i.e., substantially simultaneous administration) and non-concurrent administration (i.e., administration at different times, in any order, whether overlapping or not) of the TFPI-inhibitory peptide and one or more additionally suitable agents(s). It will be appreciated that different components are optionally administered in the same or in separate compositions, and by the same or different routes of administration.

In some embodiments, the peptide of the invention is conjugated to a moiety, e.g., a therapeutic or diagnostic moiety, such as the detection moieties and co-treatments described above. Alternatively or in addition, the peptide is administered in combination with an interaction partner (e.g., an antibody, antibody fragment, anticalin, aptamer, or spiegelmer) that (a) binds the peptide and (b) is therapeutically active and/or is linked to a moiety that provides additional functionality to the interaction partner (e.g., a therapeutic, diagnostic, or detection agent). Suitable moieties include, but are not limited to, dyes, radionuclides, radionuclide-containing complexes, enzymes, toxins, antibodies, antibody fragments, and cytotoxic agents, and, in some instances, the moiety possesses therapeutic activity (i.e., achieves an advantageous or desired biological effect). The peptide conjugates or peptide-interaction partner pair is suitable for use in any of the methods described herein, such as methods of treating a subject suffering from a disease or disorder or at risk of suffering from a disease or disorder.

All publications, patents and patent applications cited in this specification are herein incorporated by reference as if each individual publication or patent application were specifically and individually indicated to be incorporated by reference. In addition, the entire document is intended to be related as a unified disclosure, and it should be understood that all combinations of features described herein are contemplated, even if the combination of features are not found together in the same sentence, or paragraph, or section of this document. For example, where protein therapy is described, embodiments involving polynucleotide therapy (using polynucleotides/vectors that encode the protein) are specifically contemplated, and the reverse also is true. Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims. The invention includes, for instance, all embodiments of the invention narrower in scope in any way than the variations specifically mentioned above. With respect to aspects of the invention described as a genus, all individual species are individually considered separate aspects of the invention. With respect to aspects of the invention described or claimed with "a" or "an," it should be understood that these terms mean "one or more" unless context unambiguously requires a more restricted meaning. With respect to elements described as one or more within a set, it should be understood that all combinations within the set are contemplated.

EXAMPLES

Example 1

The following example describes production, identification, and screening of peptides for binding to TFPI.

Figure 5:
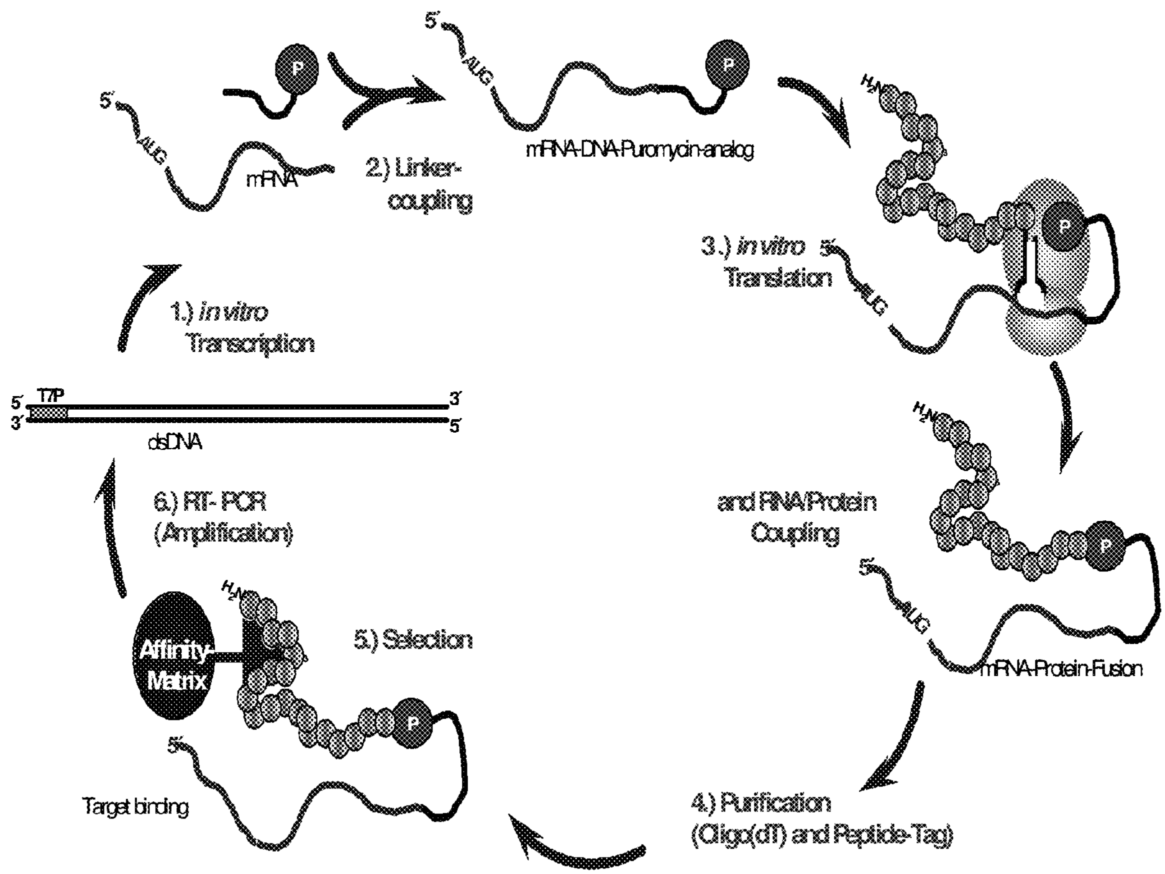
FIG. 5 is an illustration of mRNA display selection of TFPI-inhibitor peptides.

Peptides candidates were obtained from commercial suppliers (e.g., PolyPeptide Laboratories SAS (Strasbourg, France) and JPT Peptide Technologies GmbH (Berlin, Germany)). Methods for synthesizing candidate peptides are provided above. Candidate peptides were synthesized as trifluoroacetate (TFA) salts with a purity >90% or >60%. All peptides were solved in DMSO to a stock concentration of 10 mM. TFPI-binding peptide sequences were identified using an mRNA display library. The mRNA display technology is superior to other library screening techniques for allowing for a diversity of $10^{14}$ different sequences within a starting pool and avoiding, e.g., the in vivo steps required for phage display. In brief, the technology involves directly linking mRNA to its encoded candidate peptide through a puromycin molecule (FIG. 5). The mRNA display method is further described in International Patent Publication No. WO 2005/051985 and Liu et al., *Methods in Enzymology,* 318, 268-293 (2000). TFPI was immobilized to a solid support via biotin and exposed to candidate peptide-RNA complexes. TFPI-bound candidate peptide-RNA complexes were isolated, and the RNA reverse transcribed to obtain coding DNA. High affinity binders were obtained following six to ten selection rounds using a competitive elusion strategy. Many of the candidate peptides were 31 amino acids in length (27 randomized amino acids and 2 amino acids flanking both termini).

Selected peptides were synthesized and subjected to peptide optimization using a microarray-based scan analysis to identify peptide fragments retaining TFPI-binding affinity. For example, a microarray-based scan of JBT0047 was performed using a series of 20 amino acid fragments of the peptide, the sequences of which overlapped by 19 amino acids. N- and C-terminal truncation analysis supplemented the scan analysis. The microarray scan results demonstrated that that peptide JBT0293 bound TFPI with the highest affinity. A series of substitution mutants based on the amino acid sequence of JBT0293 was generated and tested for TFPI binding properties.

Figure 6A:
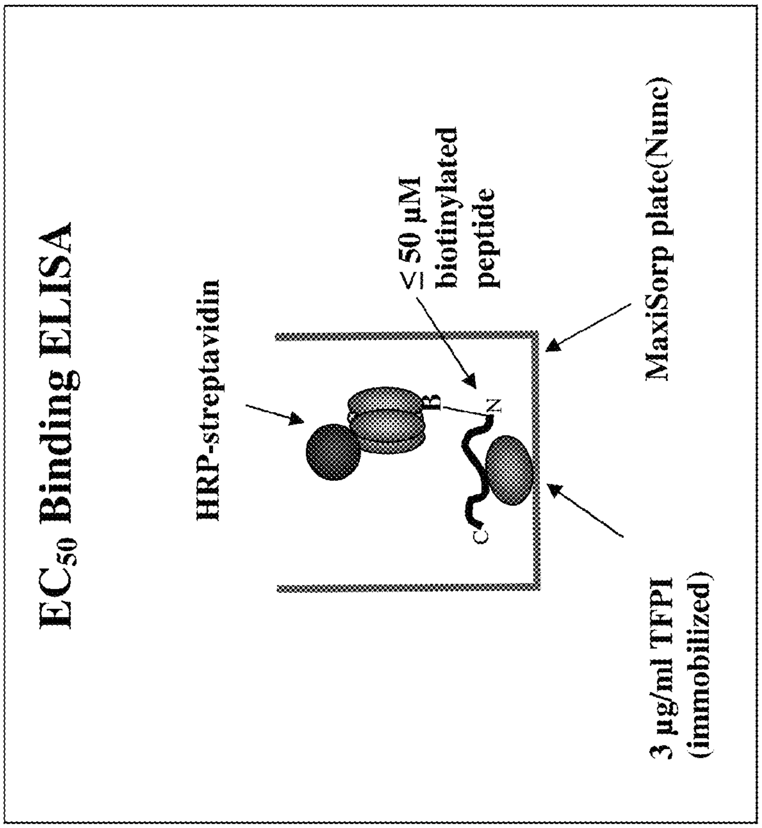
FIG. 6A is an illustration of the $EC_{50}$ binding ELISA and FIG. 6B is an illustration of the $IC_{50}$ ELISA described in Example 1.

The affinity of a subset of peptides for TFPI was demonstrated via an enzyme-linked immunosorbent assay (ELISA)-like assay (binding ($EC_{50}$) ELISA) performed with biotinylated peptides. Ninety-six well MaxiSorp plates (Nunc) were coated with 3 μg/mL TFPI in coating buffer (15 mM $Na_2CO_3$, 35 mM $NaHCO_3$, pH 9.6) over night. Plates were washed three times with 350 μl wash buffer (HNaT: 175 mM NaCl, 25 mM HEPES, 5 mM $CaCl_2$, 0.1% Tween 80, pH 7.35), and subsequently blocked with 200 μl 2% yeast extract in HNaT for 2 hours. Plates were then washed three times with 350 μl HNaT. Biotinylated candidate peptides were diluted from a DMSO stock 1/200 in HNaT. The initial peptide concentration was 50 μM if no precipitate appeared during the 1/200 dilution of the 10 mM peptide stock solution. Pre-dilutions of the peptide stock in DMSO were conducted if precipitates formed. The diluted peptides were applied to the Maxisorp plates, serial dilutions (1/3) were generated, and the dilutions were incubated for 1.5 hours at room temperature. Incubation was followed by three wash steps (350 μl HNaT). Bound peptide was detected by incubation with horseradish peroxidase-conjugated streptavidin (1 hour), followed by three wash steps with HNaT and a subsequent chromogenic conversion of added TMB (3,3'5,5'-Tetramethylbenzidin). The assay is illustrated in FIG. 6A.

Figure 7:
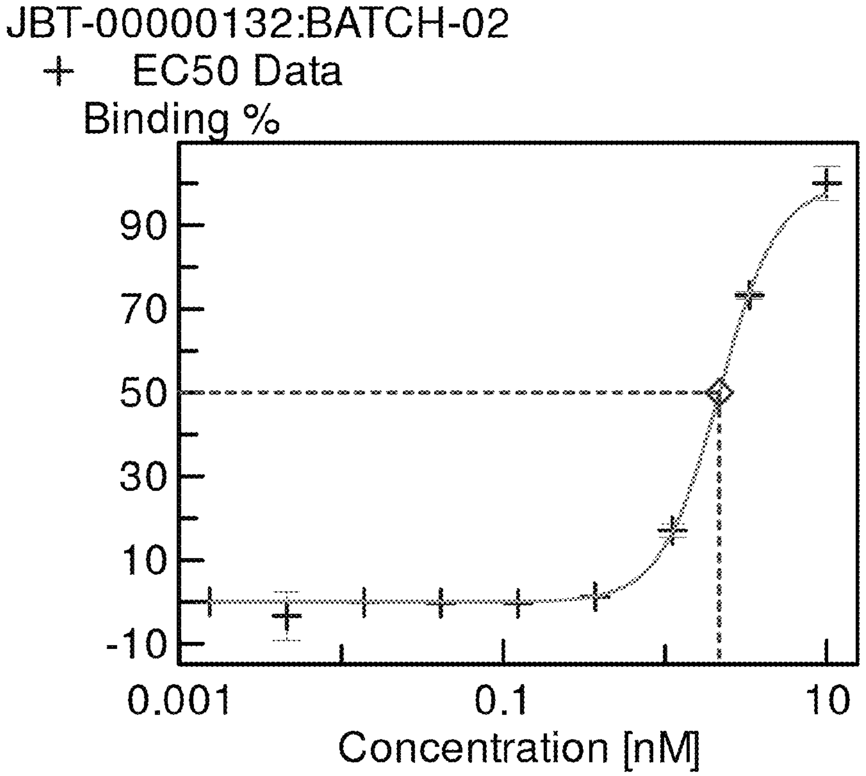
FIG. 7 is a binding ELISA curve comparing % OD (y-axis) and concentration [nM] (x-axis) for biotinylated peptide JBT0132.
Figure 8A:
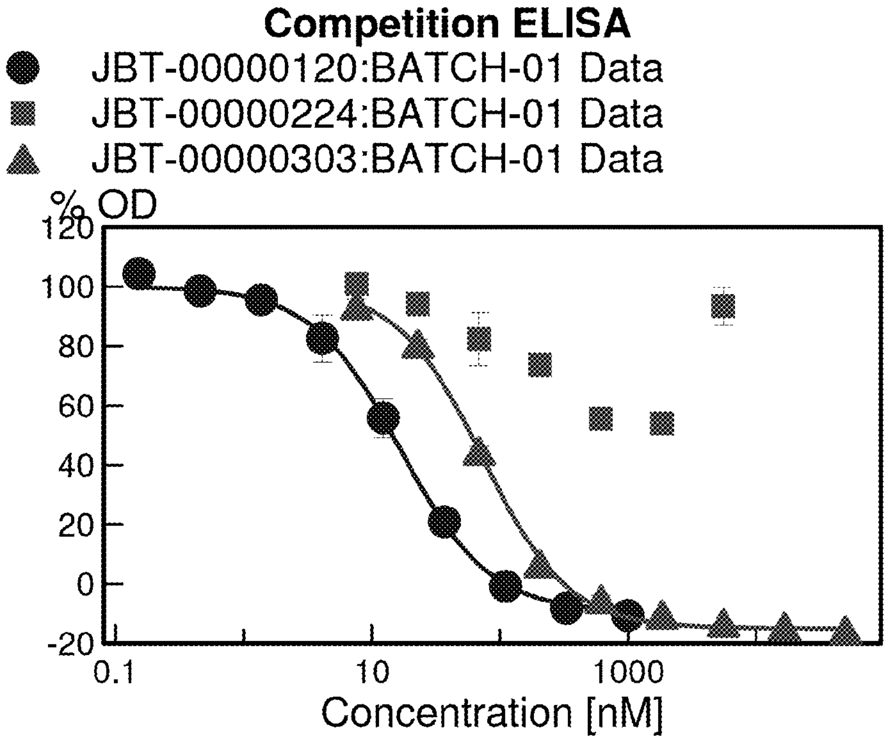
FIGS. 8A-8D are competition ELISA curves comparing % OD (y-axis) and concentration [nM] (x-axis) for exemplary peptides of the invention.
Figure 8B:
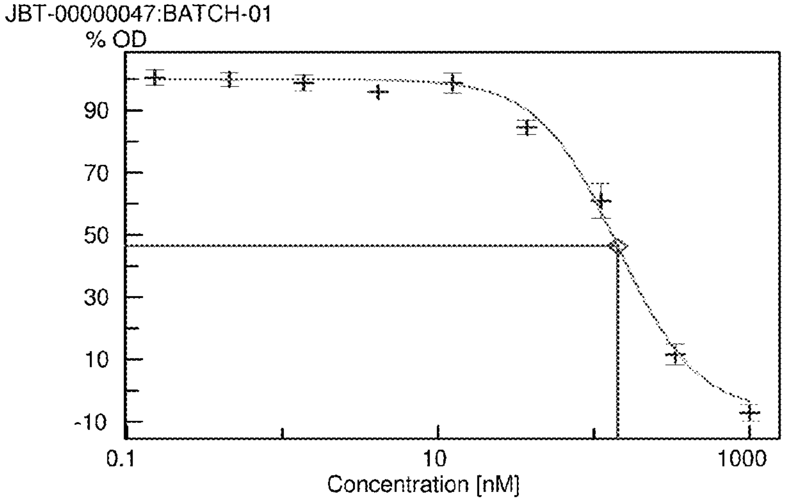
Figure 8C:
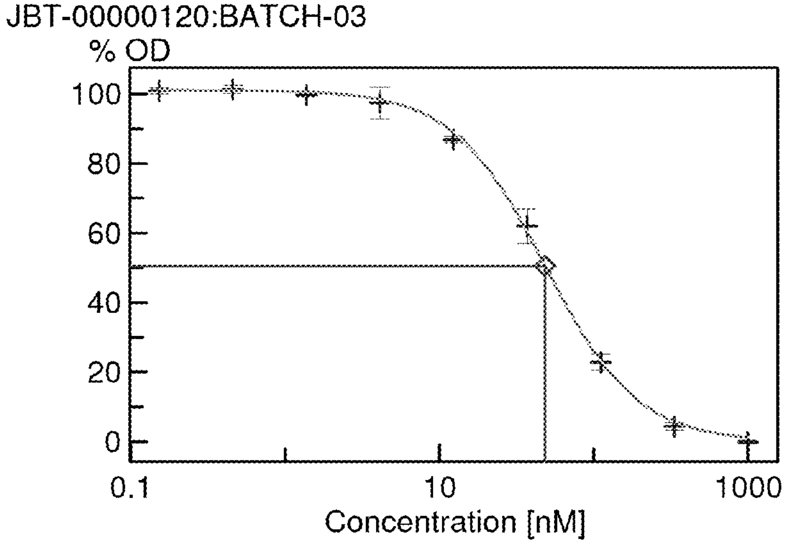
Figure 8D:
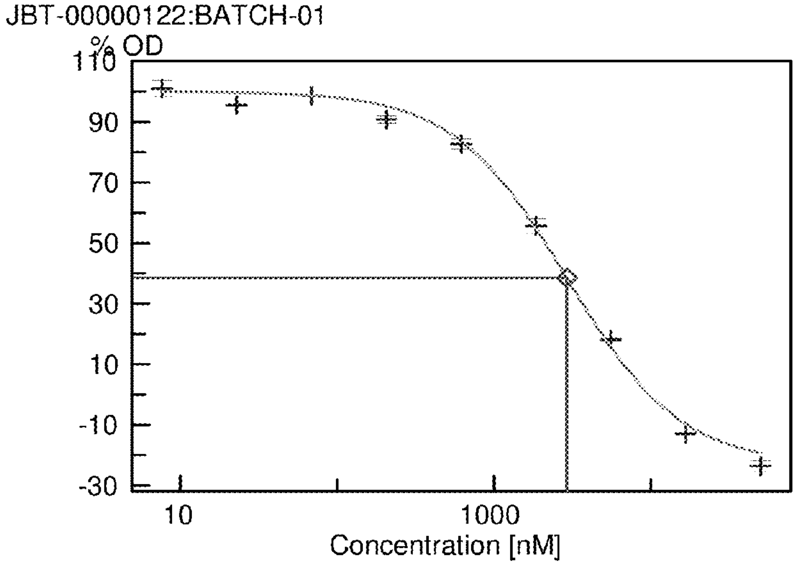

Generally, peptide binding to immobilized TFPI was significantly above background. $EC_{50}$ values for biotinylated peptides are given in FIGS. 32-39. The binding curve of one TFPI-binding peptide, JBT0132, is depicted in FIG. 7. The $EC_{50}$ of JBT0132 was calculated to be about 2.2 nM.

Figure 6B:
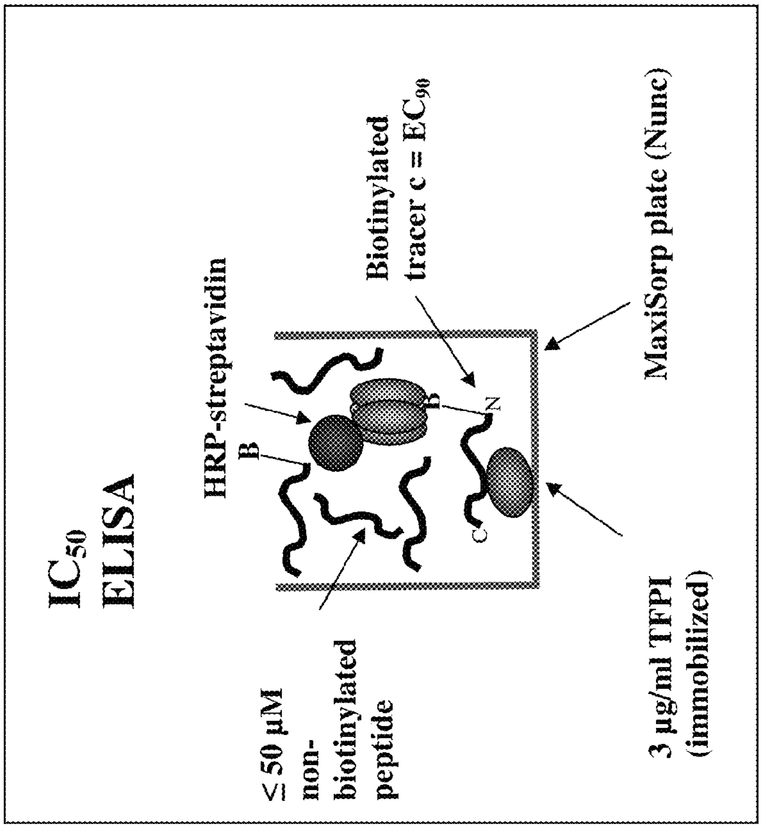

In addition, a competition ($IC_{50}$) ELISA was performed using biotinylated TFPI-binding peptides as "tracers" to compete for TFPI-binding with non-biotinylated candidate peptides. The assay principle is depicted in FIG. 6B. Ninety-six well MaxiSorp plates (Nunc) were coated with 3 μg/mL TFPI in coating buffer (15 mM $Na_2CO_3$, 35 mM $NaHCO_3$, pH 9.6) over night. Plates were washed three times with 350 μl wash buffer (HNaT: 175 mM NaCl, 25 mM HEPES, 5 mM $CaCl_2$, 0.1% Tween 80, pH 7.35), and blocked with 200 μl 2% yeast extract in HNaT for 2 hours. Plates were then washed three times with 350 μl HNaT. Biotinylated tracer peptides were applied at a concentration corresponding to their respective $EC_{90}$ values determined in the binding ELISA (median if n>2). A competitor stock solution of peptide (10 mM) was diluted 1/33.3 in HNaT without HSA, and a serial 1/3 dilution was prepared with HNaT with 3% DMSO. The dilution was further diluted with the biotinylated tracer peptide in a ratio of 1:6 (20 μl competitor dilution and 100 μl tracer peptide). The mixture of competitor and tracer peptide was applied to the TFPI-coated microtiter plate and incubated for 1.5 hours. The plates were washed three times with 350 μl HNaT. Peptide-TFPI binding was detected by applying HRP-conjugated streptavidin to the microtiter plate, incubating the mixture for one hour, washing the plate three times with 350 μl HNaT, applying TMB (3,3'5,5'-Tetramethylbenzidin), and detecting the subsequent chromogenic conversion of TMB by HRP. $IC_{50}$ graphs for representative non-biotinylated peptides are provided in FIGS. 8A-8D. $IC_{50}$ measurements of peptides JBT0303, JBT0120, and JBT0224 are set forth in Table 3.

TABLE 3

| Peptide | $IC_{50}$ [μM] | n | SD | Tracer Peptide | Tracer Concentration [μM] |
|---|---|---|---|---|---|
| JBT0303 | 0.119 | 2 | 0.064 | JBT0131 | 0.0409 |
| JBT0120 | 0.0189 | 3 | 0.0044 | JBT0124 | 0.0718 |
| JBT0224 | n.a. | 1 | | JBT0126 | 0.240 |

In addition to the competition ELISA ($IC_{50}$) assay, a screening assay was employed to measure higher numbers of peptides in parallel. The screening ELISA is similar to the competition $IC_{50}$ ELISA with the exception that only three different concentrations of the competitor were employed (300 nM, 100 nM and 33.3 nM for the JBT0047 class, and 50000 nM, 16667 nM and 5556 nM for the JBT0122 class). In some instances, screening results were expressed as percent inhibition of the tracer signal in relation to a competitive peptide (competitive peptide JBT0477 for the JBT0047 family, and competitive peptide JBT1697 for the JBT0122 family). The competition $IC_{50}$ assay results and the screening assay results of peptides prepared and screened in accordance with the methods set forth herein are provided in FIGS. 32-39. The mean $IC_{50}$ values presented in FIGS. 32-39 are based on a greater number of assays than the values presented in Table 3 and, therefore, the values may differ slightly. The results of the screening ELISA are presented as percent inhibition of tracer peptide JBT0131 binding. Several peptides that were analyzed using the $IC_{50}$ ELISA are classified in FIGS. 32-39 according to their binding affinity as set forth in Table 4.

TABLE 4

| TFPI competition ELISA $IC_{50}$ [nM] | Group |
|---|---|
| $<50$ nM | A |
| $50 \leqq x < 100$ nM | B |
| $100 \leqq x < 250$ nM | C |
| $250 \leqq x < 1000$ nM | D |
| $1000 \leqq x < 5000$ nM | E |
| $5000 \leqq x < 10000$ nM | F |
| $10000 \leqq x < 50000$ nM | G |

Exemplary TFPI-binding peptides identified using the methods described herein are presented in Table 5. Some peptides were biotinylated, and many comprise N- and C-terminal lysines to promote solubility. Several peptides exhibited TFPI-inhibitory activity in model and/or plasmatic assay systems, as described below.

TABLE 5

| Peptide | Parent | Sequence | SEQ ID |
|---|---|---|---|
| | JBT0047 | QSKKNVFVFGYFERLRAK | 1 |
| JBT0047 | JBT0047 | Ac-SGVGRLQVAFQSKKNVFVFGYFERLRAKLTS-NH2 | 253 |
| JBT0051 | JBT0047 | Biotinyl-Ttds-SGVGRLQVAFQSKKNVFVFGYFERLRAKLTS-NH2 | 962 |
| JBT0055 | JBT0047 | Ac-SGVGRLQVAFQSKKNVFVFGYFERLRAKLTS-Ttds-Lys(Biotinyl)-NH2 | 963 |
| JBT0131 | JBT0047 | Biotinyl-Ttds-AFQSKKNVFVFGYFERLRAK-NH2 | 964 |
| JBT0132 | JBT0047 | Biotinyl-Ttds-FQSKKNVFVFGYFERLRAKL-NH2 | 965 |
| JBT0133 | JBT0047 | Biotinyl-Ttds-QSKKNVFVFGYFERLRAKLT-NH2 | 966 |
| JBT0155 | JBT0047 | Ac-KKSGVGRLQVAFQSKKNVFVFGYFERLRAKLTSKK-NH2 | 8 |
| JBT0158 | JBT0047 | Ac-KKSGVGRLQVAFQSKKNVFVFGYFERLRAKKK-NH2 | 9 |
| JBT0162 | JBT0047 | Ac-KKGRLQVAFQSKKNVFVFGYFERLRAKLTSKK-NH2 | 10 |
| JBT0163 | JBT0047 | Ac-KKQVAFQSKKNVFVFGYFERLRAKLTSKK-NH2 | 11 |
| JBT0164 | JBT0047 | Ac-KKFQSKKNVFVFGYFERLRAKLTSKK-NH2 | 12 |
| JBT0166 | JBT0047 | Biotinyl-Ttds-KKFQSKKNVFVFGYFERLRAKLKK-NH2 | 968 |
| JBT0169 | JBT0047 | Ac-KKAFQSKKNVFVFGYFERLRAKKK-NH2 | 254 |
| JBT0170 | JBT0047 | Ac-KKFQSKKNVFVFGYFERLRAKLKK-NH2 | 13 |
| JBT0171 | JBT0047 | Ac-KKQSKKNVFVFGYFERLRAKLTKK-NH2 | 255 |
| JBT0174 | JBT0047 | Ac-KKAFQSKKNVFVFGYFERLRAKLKK-NH2 | 14 |
| JBT0175 | JBT0047 | Ac-KKAFQSKKNVFVFGYFERLRAKLTKK-NH2 | 182 |
| JBT0293 | JBT0047 | Ac-FQSKKNVFVFGYFERLRAKL-NH2 | 256 |
| | | $X_3X_4X_5KX_7NVFX_{11}X_{12}GYX_{15}X_{16}RLRAKX_{22}$ | 2 |
| JBT0294 | JBT0047 | Ac-YQSKKNVFVFGYFERLRAKL-NH2 | 257 |
| JBT0295 | JBT0047 | Ac-FSSKKNVFVFGYFERLRAKL-NH2 | 713 |
| JBT0296 | JBT0047 | Ac-FQNKKNVFVFGYFERLRAKL-NH2 | 407 |
| JBT0297 | JBT0047 | Ac-FQSKNNVFVFGYFERLRAKL-NH2 | 183 |
| JBT0298 | JBT0047 | Ac-FQSKQNVFVFGYFERLRAKL-NH2 | 747 |
| JBT0299 | JBT0047 | Ac-FQSKKNVFAFGYFERLRAKL-NH2 | 408 |
| JBT0300 | JBT0047 | Ac-FQSKKNVFSFGYFERLRAKL-NH2 | 409 |
| JBT0301 | JBT0047 | Ac-FQSKKNVFTFGYFERLRAKL-NH2 | 470 |
| JBT0302 | JBT0047 | Ac-FQSKKNVFVAGYFERLRAKL-NH2 | 258 |
| JBT0303 | JBT0047 | Ac-FQSKKNVFVDGYFERLRAKL-NH2 | 184 |
| JBT0304 | JBT0047 | Ac-FQSKKNVFVLGYFERLRAKL-NH2 | 259 |
| JBT0305 | JBT0047 | Ac-FQSKKNVFVQGYFERLRAKL-NH2 | 260 |
| JBT0306 | JBT0047 | Ac-FQSKKNVFVSGYFERLRAKL-NH2 | 185 |
| JBT0307 | JBT0047 | Ac-FQSKKNVFVYGYFERLRAKL-NH2 | 261 |
| JBT0308 | JBT0047 | Ac-FQSKKNVFVFGYKERLRAKL-NH2 | 411 |
| JBT0309 | JBT0047 | Ac-FQSKKNVFVFGYYERLRAKL-NH2 | 412 |
| JBT0310 | JBT0047 | Ac-FQSKKNVFVFGYFDRLRAKL-NH2 | 262 |
| JBT0311 | JBT0047 | Ac-FQSKKNVFVFGYFERLRAKN-NH2 | 748 |
| | | TFVDERLLYFLTIGNMGMYAAQLKF | 3 |

TABLE 5-continued

| Peptide | Parent | Sequence | SEQ ID |
|---|---|---|---|
| JBT0049 | JBT0049 | Ac-SGNTFVDERLLYFLTIGNMGMYAAQLKFRTS-NH2 | 3025 |
| JBT0053 | JBT0049 | Biotinyl-Ttds-SGNTFVDERLLYFLTIGNMGMYAAQLKFRTS-NH2 | 3006 |
| JBT0057 | JBT0049 | Ac-SGNTFVDERLLYFLTIGNMGMYAAQLKFRTS-Ttds-Lysin(biotin)-NH2 | 3018 |
| JBT0190 | JBT0049 | Ac-KKSGNTFVDERLLYFLTIGNMGMYAAQLKFRTSKK-NH2 | 3031 |
| JBT0193 | JBT0049 | Ac-KKSGNTFVDERLLYFLTIGNMGMYAAQLKFKK-NH2 | 3073 |
| JBT0197 | JBT0049 | Ac-KKTFVDERLLYFLTIGNMGMYAAQLKFRTSKK-NH2 | 3076 |
| | | VIVFTFRHNKLIGYERRY | 4 |
| JBT0050 | JBT0050 | Ac-SGRGCTKVIVFTFRHNKLIGYERRYNCTS-NH2 | 3047 |
| JBT0054 | JBT0050 | Biotinyl-Ttds-SGRGCTKVIVFTFRHNKLIGYERRYNCTS-NH2 | 3002 |
| JBT0058 | JBT0050 | Ac-SGRGCTKVIVFTFRHNKLIGYERRYNCTS-Ttds-Lysin(biotin)-NH2 | 3003 |
| JBT0129 | JBT0050 | Ac-SGRG[CTKVIVFTFRHNKLIGYERRYNC]TS-NH2 | 3026 |
| JBT0130 | JBT0050 | Biotinyl-Ttds-SGRG[CTKVIVFTFRHNKLIGYERRYNC]TS-NH2 | 3001 |
| JBT0205 | JBT0050 | Ac-KKSGRGCTKVIVFTFRHNKLIGYERRYNCTSKK-NH2 | 3029 |
| JBT0208 | JBT0050 | Ac-KKSGRGCTKVIVFTFRHNKLIGYERRYNKK-NH2 | 3027 |
| JBT0211 | JBT0050 | Ac-KKGCTKVIVFTFRHNKLIGYERRYNCTSKK-NH2 | 3032 |
| JBT0212 | JBT0050 | Ac-KKKVIVFTFRHNKLIGYERRYNCTSKK-NH2 | 3033 |
| JBT0217 | JBT0050 | Ac-KKTKVIVFTFRHNKLIGYERRYKK-NH2 | 3062 |
| JBT0218 | JBT0050 | Ac-KKKVIVFTFRHNKLIGYERRYNKK-NH2 | 3063 |
| JBT0219 | JBT0050 | Ac-KKVIVFTFRHNKLIGYERRYNCKK-NH2 | 3030 |
| | | GVWQTHPRYFWTMWPDIKGEVIVLFGT | 5 |
| JBT0101 | JBT0101 | Ac-KKSGVWQTHPRYFWTMWPDIKGEVIVLFGTSKK-NH2 | 3036 |
| JBT0052 | JBT0101 | Biotinyl-Ttds-KKSGVWQTHPRYFWTMWPDIKGEVIVLFGTSKK-NH2 | 3004 |
| JBT0103 | JBT0101 | Ac-KKSGVWQTHPRYFWTMWPDIKGEVIVLFGTS-Ttds-KK-Lysin(biotinyl)-NH2 | 3005 |
| JBT0178 | JBT0101 | Ac-KKSGVWQTHPRYFWTMWPDIKGEVIVLFGTKK-NH2 | 3028 |
| JBT0182 | JBT0101 | Ac-KKGVWQTHPRYFWTMWPDIKGEVIVLFGTSKK-NH2 | 3037 |
| | | KWFCGMRDMKGTMSCVWVKF | 6 |
| JBT0120 | JBT0120 | Ac-SGASRYKWF[CGMRDMKGTMSC]VWVKFRYDTS-NH2 | 1047 |
| JBT0124 | | Biotinyl-Ttds-SGASRYKWF[CGMRDMKGTMSC]VWVKFRYDTS-NH2 | 1290 |
| JBT0247 | JBT0120 | Ac-SGASRYKWFCGMRDMKGTMSCVWVKFRYDTS-NH2 | 1213 |
| JBT0248 | JBT0120 | Ac-KKSGASRYKWF[CGMRDMKGTMSC]VWVKFRYDTSKK-NH2 | 1001 |
| JBT0251 | JBT0120 | Ac-KKKWFCGMRDMKGTMSCVWVKFKK-NH2 | 1202 |
| JBT0252 | JBT0120 | Ac-KKCGMRDMKGTMSCVWVKFRYDKK-NH2 | 1215 |
| | | ASFPLAVQLHVSKRSKEMA | 7 |
| JBT0122 | JBT0122 | Ac-SGYASFPLAVQLHVSKRSKEMALARLYYKTS-NH2 | 2002 |
| JBT0126 | JBT0122 | Biotinyl-Ttds-SGYASFPLAVQLHVSKRSKEMALARLYYKTS-NH2 | 2498 |
| JBT0221 | JBT0122 | Ac-KKSGYASFPLAVQLHVSKRSKEMALARLYYKTSKK-NH2 | 2003 |
| JBT0224 | JBT0122 | Ac-KKSGYASFPLAVQLHVSKRSKEMALARLYYKK-NH2 | 2298 |
| JBT0225 | JBT0122 | Ac-KKSGYASFPLAVQLHVSKRSKEMALARKK-NH2 | 2128 |

TABLE 5-continued

| Peptide | Parent | Sequence | SEQ ID |
|---|---|---|---|
| JBT0226 | JBT0122 | Ac-KKSGYASFPLAVQLHVSKRSKEMAKK-NH2 | 2299 |
| JBT0228 | JBT0122 | Ac-KKASFPLAVQLHVSKRSKEMALARLYYKTSKK-NH2 | 2016 |
| JBT0232 | JBT0122 | Ac-KKGYASFPLAVQLHVSKRSKEMKK-NH2 | 2303 |
| JBT0233 | JBT0122 | Ac-KKYASFPLAVQLHVSKRSKEMAKK-NH2 | 2304 |

This example provides exemplary methods of generating and characterizing TFPI-inhibitory peptides. All peptides in Table 5 were found to bind human TFPI-1α. Mutation analysis demonstrated that at least one amino acid in a TFPI-binding peptide may be substituted while retaining affinity for TFPI. The peptides of Table 5 tested in ELISA assays bound TFPI-1α with an $EC_{50}$ of less than 10 μM ($1\times10^{-5}$ M) and an $IC_{50}$ of less than 50 μM.

Example 2

Selected TFPI-binding peptides were further characterized in terms of "anti-target" binding. This example demonstrates that TFPI-inhibitory peptides exhibit reduced affinity for non-TFPI-1 proteins.

TFPI-2 was selected as an anti-target because of its similarity to TFPI-1. The binding kinetics of TFPI-binding peptides to human TFPI-1 (residues 29-282 fused at the C-terminus to a 10 His-tag; MW 41 kDa (R&D Systems, Minneapolis, Minn.; catalog number 2974-PI)) murine TFPI-1 (residues 29-289 fused at the C-terminus to a 10 His-tag; MW 41 kDa (R&D Systems; catalogue number 2975-PI)), and TFPI-2 (R&D Systems, Minneapolis, Minn.) were studied using a BIAcore 3000™ surface plasmon resonance assay (GE Healthcare, Chalfont St. Giles, UK). TFPI proteins were immobilized on a Cl chip (GE Healthcare, Order Code: BR-1005-40) by amine coupling chemistry aiming for 500 RU. Several TFPI-binding peptides were employed as analytes for interacting with the immobilized TFPI proteins. A flow rate of 30 μl/min was utilized. After 180 seconds, 180 μl of peptide solution was injected at six different concentrations ranging from 3.84 nM to 656.25 nM, followed by a dissociation time of 480 seconds. The chip was regenerated with 45 μl 10 mM NaOH. Each binding experiment was preceded and followed by four measurements with HBS-P buffer (10 mM HEPES, pH 7.4, 150 mM NaCl, 0.005% P20) plus 1% DMSO and 0.8% P80. BIAevaluation® Version 4.1 software (GE Healthcare) was employed to analyze the data. Sensorgrams were fitted to a 1:1 Langmuir binding curve to determine $k_{on}$ and $k_{off}$ and calculate $K_D$.

Figure 9A:
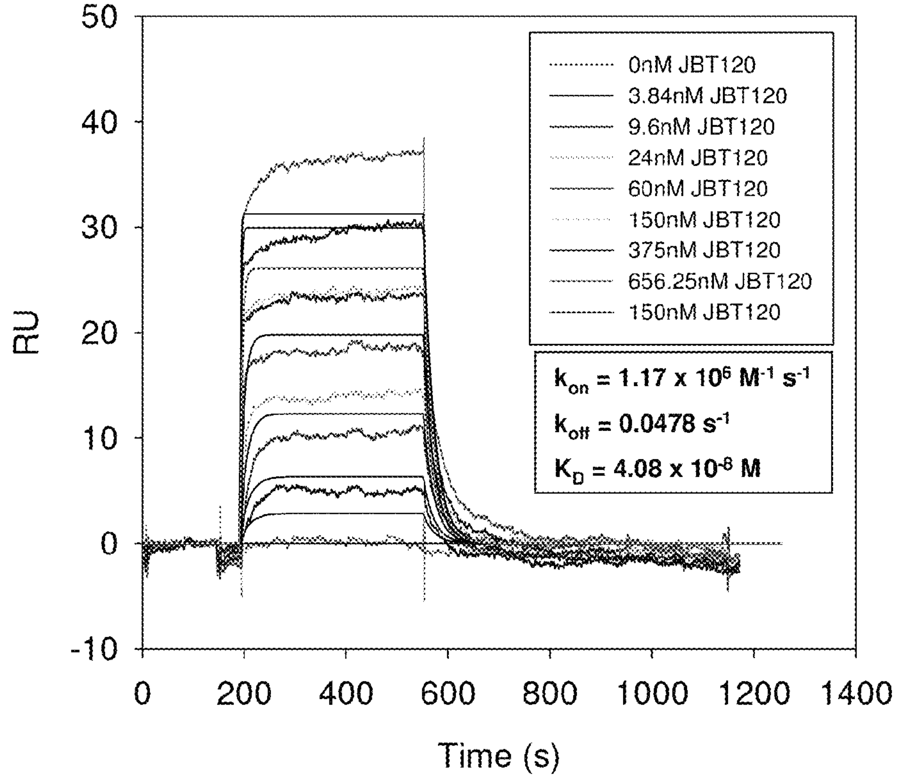
FIGS. 9A and 9B are sensorgrams plotting RU (y-axis) against time in seconds (x-axis) for peptides JBT0120 and JBT0132.
Figure 9B:
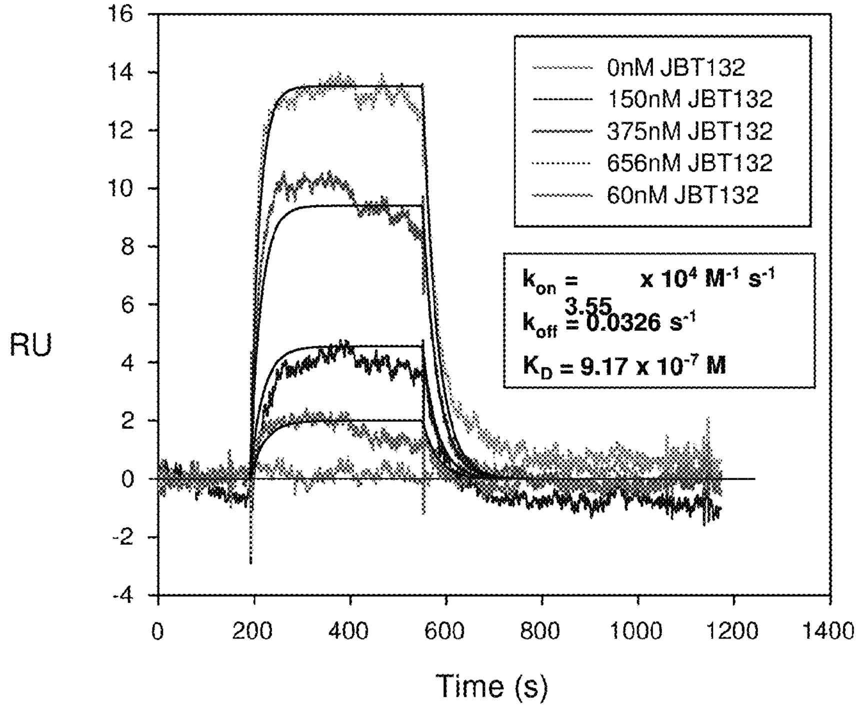

Certain tested peptides, e.g., JBT0050, JBT0121, JBT0205 and JBT0211, bound to the blank cell and binding constants from those sensorgrams could not be determined. JBT0133 showed weak binding to TFPI-1. Sensorgrams from other peptides gave reliable binding constants. Results from BIAcore analysis of several TFPI-inhibitory peptides is provided in Table 6 and FIGS. 19-21. Each of the peptides listed in Table 6 presented a $K_D$ of less than 10 μM. Sensorgrams of two of the peptides are provided as FIGS. 9A and 9B.

TABLE 6

| Peptide | $k_{on}$ (1/Ms) | $k_{off}$ (1/s) | $K_D$ (M) |
|---|---|---|---|
| JBT0047 | $4.0\times10^{5}$ | $1.9\times10^{-2}$ | $4.7\times10^{-8}$ |
| JBT0120 | $1.17\times10^{6}$ | $4.78\times10^{-2}$ | $4.08\times10^{-8}$ |
| JBT0131 | $1.4\times10^{5}$ | $6.0\times10^{-2}$ | $4.31\times10^{-7}$ |
| JBT0132 | $3.55\times10^{4}$ | $3.26\times10^{-2}$ | $9.17\times10^{-7}$ |
| JBT0224 | $6.39\times10^{4}$ | $1.95\times10^{-2}$ | $3.05\times10^{-7}$ |
| JBT0293 | $6.0\times10^{5}$ | $5.6\times10^{-2}$ | $9.5\times10^{-8}$ |
| JBT0297 | $5.0\times10^{5}$ | $1.4\times10^{-2}$ | $2.9\times10^{-8}$ |
| JBT0303 | $8.13\times10^{5}$ | $2.75\times10^{-2}$ | $3.4\times10^{-8}$ |
| JBT0305 | $7.5\times10^{5}$ | $3.1\times10^{-2}$ | $6.1\times10^{-8}$ |

Figure 10A:
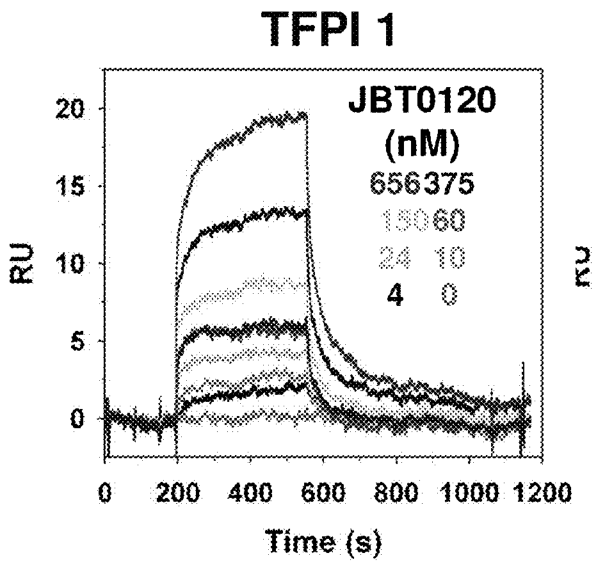
FIGS. 10A and 10B are sensorgrams plotting RU (y-axis) against time in seconds (x-axis) for peptide JBT0120 interaction with Tissue Factor Pathway Inhibitor-1 and Tissue Factor Pathway Inhibitor-2.
Figure 10B:
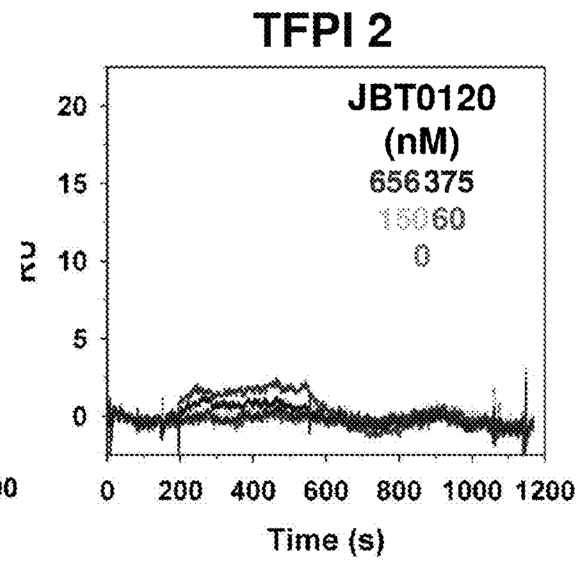

Interaction with the TFPI-2 anti-target also was examined. The maximum signal generated from candidate peptide interaction with human TFPI-2 was much lower than the signals obtained with TFPI-1 as an interaction partner. Kinetic analysis of the low TFPI-2 binding signals was prone to error; therefore, visual comparison of sensorgrams was used to estimate binding affinity. A sensorgram illustrating JBT0120 binding to TFPI-1 and TFPI-2 is provided as FIGS. 10A and 10B. JBT0120 binds TFPI-2 with 10-fold lower affinity compared to its binding affinity for TFPI-1. JBT0132 also was found to exhibit at least 10-fold greater affinity for TFPI-1 than TFPI-2.

The data provided by this example confirm that TFPI-inhibitory peptides specifically bind TFPI-1.

Example 3

The following example describes the characterization of TFPI-inhibitory activity of select peptides identified in Example 1 using a FXa inhibition and extrinsic tenase inhibition assay. Both assays are predictive of activity in plasmatic systems. The extrinsic tenase assay gives insight into the influence of the peptides on (a) the interaction of FXa and TFPI and (b) the interaction of the FXa-TFPI complex with the TF-FVIIa complex. The FXa inhibition assay measures a peptide's influence on the interaction of FXa and TFPI only.

The extrinsic tenase complex is responsible for FX and FIX activation upon initiation of the coagulation process. The extrinsic complex is composed of FVIIa, Tissue Factor (TF), and FX substrate. To determine the influence of peptides on the TFPI-mediated inhibition of the extrinsic tenase complex, a coupled enzyme assay was established. Peptides were diluted 1/6.25 from 10 mM stocks (in DMSO) and further diluted by serial 1/4 dilutions in DMSO to prevent unwanted precipitation. TFPI was diluted in HNaCa—HSA (25 mM HEPES; 175 mM NaCl; 5 mM $CaCl_2$; 0.1% HSA; pH 7.35). FVIIa, lipidated TF, phospholipid vesicles (DOPC/POPS 80/20), and chromogenic substrate specific for FXa (S-2222 (available from DiaPharma, West Chester, Ohio)), all diluted in HNaCa—HSA, were added to 96-well plates. After an incubation period, TFPI and peptide dilutions were added, resulting in a final concentration of 2.5% DMSO. FX activation was initiated by adding FX to the wells. FXa-mediated chromogenic substrate conversion was determined by observing an increase in absorbance using a micro-plate reader. The amount of FXa generated at certain time points was calculated from the OD readings. FXa generated at 20 minutes after start of the reaction was considered for calculation of $EC_{50}$ from plots of peptide concentration versus the inhibition of TFPI (%).

The functional inhibition of TFPI also was examined using a FXa inhibition assay. A FXa-specific chromogenic substrate (S-2222) and TFPI, both diluted in HNaCa—HSA, were added to 96 well plates. Peptides were diluted 1/6.25 from 10 mM stocks (in DMSO) and further diluted by serial 1/4 dilutions in DMSO to prevent unwanted precipitation. The peptide dilutions (2.5 μl) were added to the 96 well plates, resulting in a final concentration of 2.5% DMSO. The conversion of chromogenic substrate was triggered by the addition of FXa, and the kinetics of the conversion were measured in a micro-plate reader. Because TFPI inhibits FXa slowly, OD readings after 115 minutes were considered for calculation of the $EC_{50}$ from plots of peptide concentration versus the inhibition of TFPI (%).

Results from the extrinsic tenase assay and FXa inhibition assay are provided in Table 7 and FIGS. 22-27.

TABLE 7

| | FXa Inhibition Assay | | Extrinsic Tenase Assay | |
|---|---|---|---|---|
| | $EC_{50}$ [μM] | % inhibition @ 2.5 μM | $EC_{50}$ [μM] | % inhibition @ 2.5 μM |
| JBT0120 | 0.9 | 45 | 0.9 | 45 |
| JBT0132 | 1.2 | 36 | 0.1 | 10 |
| JBT0224 | n.a. | 26 | 3.5 | 18 |
| JBT0303 | 1.2 | 61 | n.a. | 8 |

Referring to Table 7, JBT0120, JBT0132, and JBT0224 restored extrinsic complex-mediated FX activation in the presence of TFPI-1 with an $EC_{50}$ of <2 μM, resulting in between about 20% to about 60% inhibition of TFPI activity. JBT0047 ($EC_{50}$=1.4 μM), JBT0131 ($EC_{50}$=2.2 μM), and JBT0293 ($EC_{50}$=2.9 μM) also restored extrinsic complex activity in the presence of TFPI-1. In addition, JBT0120, JBT0132, JBT0224, and JBT0303 restored FXa activity in the presence of TFPI-1 with an $EC_{50}$ of <5 μM, resulting in between about 5% to about 50% inhibition of TFPI activity, in the FXa inhibition assay. JBT0047 ($EC_{50}$=0.7 μM), JBT0131 ($EC_{50}$=8.2 μM), JBT0293 ($EC_{50}$=1.3 μM), JBT0297 ($EC_{50}$=0.6 μM), and JBT0305 ($EC_{50}$=2.3 μM) also restored activity of FXa in the presence of TFPI-1 in the FXa inhibition assay. This example confirms that peptides of the invention are TFPI antagonists.

Example 4

In this example, the TFPI inhibitory activity of peptides is established using a plasma-based assay.

The influence of peptides on thrombin generation was measured in duplicate via calibrated automated thrombography in a Fluoroskan Ascent® reader (Thermo Labsystems, Helsinki, Finland; filters 390 nm excitation and 460 nm emission) following the slow cleavage of the thrombin-specific fluorogenic substrate Z-Gly-Gly-Arg-AMC (Hemker, *Pathophysiol. Haemost. Thromb.,* 33, 4-15 (2003)). Plasma from patients with FVIII or FIX deficiency (George King Bio-Medical Inc., Overland Park, KN) was obtained for testing. The residual coagulation factor activity for each of the plasmas was lower than 1%. As a model for antibody-mediated FVIII deficiency, frozen pooled normal plasma (George King Bio-Medical Inc., Overland Park, KN) was incubated with high titer, heat inactivated, anti-human FVIII plasma raised in goat (4490 BU/ml; Baxter BioScience, Vienna, Austria) giving rise to 50 BU/mL. The plasmas were mixed with corn trypsin inhibitor (CTI) (Hematologic Technologies, Inc., Essex Junction, Vt.) to inhibit Factor XIIa contamination, resulting in a final concentration of 40 μg/mL.

Pre-warmed (37° C.) plasma (80 μL) was added to each well of a 96 well micro-plate (Immulon 2HB, clear U-bottom; Thermo Electron, Waltham, Mass.). To trigger thrombin generation by Tissue Factor, 10 μL of PPP low reagent containing low amounts (12 pM) of recombinant human Tissue Factor and phospholipid vesicles composed of phosphatidylserine, phosphatidylcholine and phosphatidylethanolamine (48 μM) (Thrombinoscope BV, Maastricht, The Netherlands) were added. Peptides were diluted 1/7.5 from 10 mM stocks with DMSO, and further diluted 1/8.33 with Aqua-Dest resulting in a DMSO concentration of 12%, providing a 0.5% DMSO concentration in the final assay mix. Just prior putting the plate into the pre-warmed (37° C.) reader, 5 μL of HEPES buffered saline with 5 mg/mL human serum albumin (Sigma-Aldrich Corporation, St. Louis, Mo., USA) or 12% DMSO in Aqua-Dest was added, followed by addition of the peptide dilutions or reference proteins (FVIII Immunate reference standard (Baxter BioScience, Vienna, Austria); Factor VIII Inhibitor By-Passing Activity (FEIBA) reference standard (Baxter BioScience, Vienna, Austria); NovoSeven (Novo Nordisk, Denmark); and purified human plasma FIX (Enzyme Research Laboratories, South Bend, Ill.)). Thrombin generation was initiated by dispensing into each well 20 μL of FluCa reagent (Thrombinoscope BV, Maastricht, The Netherlands) containing a fluorogenic substrate and HEPES-buffered $CaCl_2$ (100 mM). Fluorescence intensity was recorded at 37° C.

The parameters of the resulting thrombin generation curves were calculated using Thrombinoscope™ software (Thrombinoscope BV, Maastricht, The Netherlands) and thrombin calibrator to correct for inner filter and substrate consumption effects (Hemker, *Pathophysiol. Haemost. Thromb.,* 33, 4-15 (2003)). For calculating the thrombin generating activity of certain peptide concentrations equivalent to the reference proteins (e.g., FVIII Immunate® reference standard, FEIBA reference standard), the thrombin amounts at the peak of each thrombin generation curve (peak thrombin, nM) were plotted against the standard concentrations, and fitted by a non-linear algorithm. Based on this calibration, FVIII Immunate, FIX, FEIBA or NovoSeven equivalent activities were calculated. Results for various peptides are provided in FIGS. 12-18 and 28-30. Representative results are provided in Table 8. (* denotes that FVIII deficient plasma was obtained from a different donor.)

TABLE 8

| | % FVIII-equivalent activity in FVIII deficient plasma @ 10 μM peptide | FEIBA-equivalent activity in FVIII inhibited plasma @ 10 μM peptide [mU/ml] |
|---|---|---|
| JBT0120 | 37.4* | 298 |
| JBT0132 | 5.3 | 41 |
| JBT0224 | 16.2 | 191 |
| JBT0303 | 20.8 | 253 |

Figure 11A:
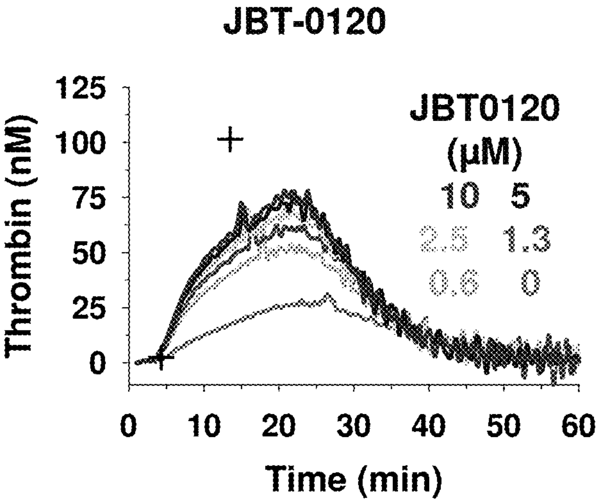
FIGS. 11A and 11B are graphs comparing amount of thrombin generated (nM) (y-axis) and time in minutes (x-axis) for peptide JBT0120 and peptide JBT0132 in a plasma-based assay.
Figure 11B:
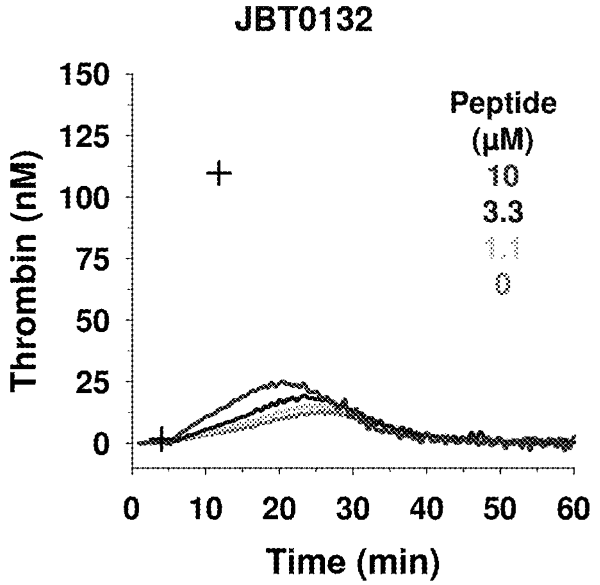

With reference to Table 8, JBT0120, JBT0132, JBT0224, and JBT0303 improved TFPI-dependent thrombin generation in FVIII-depleted plasma to levels exceeding 1% of the level of thrombin generation in plasma containing FVIII (% FVIII-equivalent activity). The tested peptides exhibited approximately 5%-40% FVIII-equivalent activity in FVIII-deficient plasma. JBT0120 and JBT0132 improved peak thrombin and peak time, dose dependently, as illustrated in FIGS. 11A and 11B.

Example 5

The following example demonstrates that the peptides of the invention can be modified by the addition of moieties that enhance physicochemical or pharmacokinetic properties of the peptides. As illustrated below, the addition of 40 kDa PEG to peptides described herein dramatically improved the pharmacokinetic behavior of the peptides.

Methods of conjugating chemical or biological moieties to peptides are known in the art. To add PEG (polyethylene glycol) to the peptides describe herein, a functional group (AOA=aminooxy acetate) was added to the N-terminus of the peptides for coupling to aldehydes and ketones. Alternatively, a cysteine was added to the C-terminal part of the peptide for coupling with maleimid (Hermanson, Bioconjugate Techniques, Academic Press (1996)). The peptides (JBT1586) AOA-FQSKGNVFVDGYFERL-Aib-AKL-NH2 (SEQ ID NO: 166) and (JBT1587) Ac-FQSKGNVFVDGYFERL-Aib-AKLC-NH2 (SEQ ID NO: 167) were used for N-terminal and C-terminal modification with PEG, respectively. AOA-FQSKGNVFVDGYFERL-Aib-AKL-NH2 (SEQ ID NO: 166) and Ac-FQSKGNVFVDGYFERL-Aib-AKLC-NH2 (SEQ ID NO: 167) were incubated with excess 40 kDa mPEG-Propionaldehyde (SUNBRIGHT ME-400AL2, NOF, Japan) and 40 kDa mPEG-maleimide (SUNBRIGHT ME-400MA, NOF, Japan), respectively. The resulting PEGylated peptides, JBT1853 and JBT1855, show similar affinities compared to the starting structure Ac-FQSKGNVFVDGYFERL-Aib-AKL-NH2 (JBT0740) (SEQ ID NO: 66).

Figure 31:
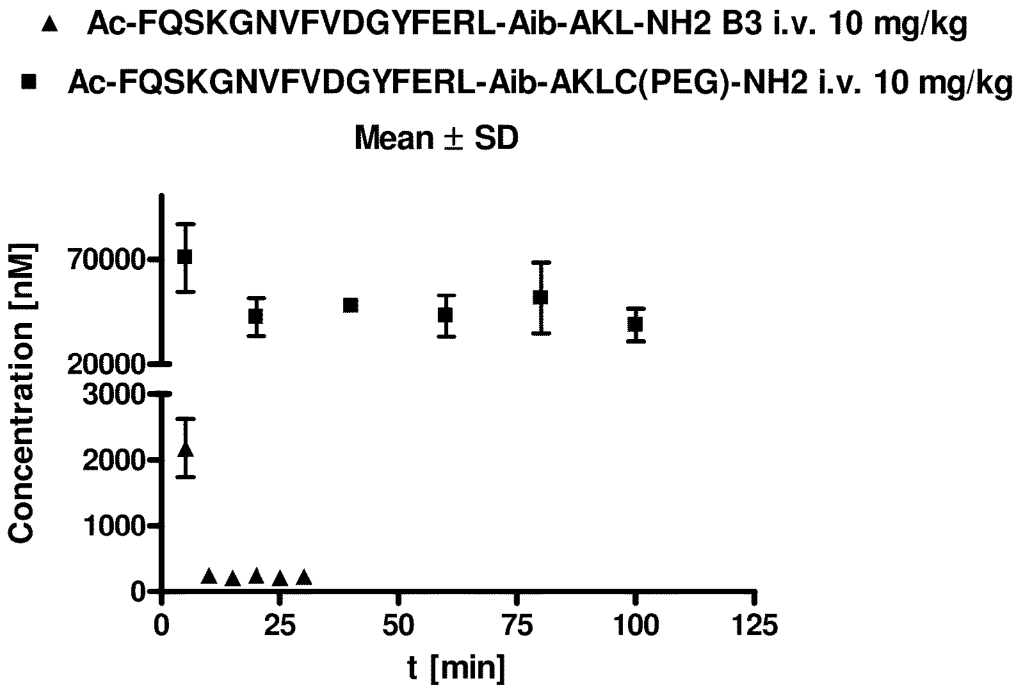
FIG. 31 is a graph comparing a pharmacokinetic characteristic (concentration of peptide (y-axis) versus time after administration (x-axis)) of a PEGylated TFPI-binding peptide to the pharmacokinetic characteristic of same peptide lacking PEG. The peptides were administered intravenously to C57Bl6 mice at a dose of 10 mg/kg. Three biological samples were analyzed for the presence of peptide at each time point.

The resulting PEGylated peptides demonstrated significantly increased plasma stability and prolonged plasma half-life in mice. FIG. 31 illustrates the results from a pharmacokinetic analysis of the free peptide JBT0740 (Ac-FQSKGNVFVDGYFERL-Aib-AKL-NH2) (SEQ ID NO: 66) compared to the C-terminally PEGylated peptide JBT1855 (Ac-FQSKGNVFVDGYFERL-Aib-AKLC(PEG (40 kD))-NH2) (SEQ ID NO: 252). In contrast to the unPEGylated peptide, the PEGylated peptide is present at high concentrations in mouse plasma at 100 minutes post-administration. The unPEGylated peptide is rapidly cleared from the plasma.

---

SEQUENCE LISTING (3145 sequences)

SEQ ID NO: 1 - protein, 18 aa, Artificial Sequence
  Synthetic peptide
QSKKNVFVFGYFERLRAK

SEQ ID NO: 2 - protein, 20 aa, Artificial Sequence
  Synthetic peptide
  MOD_RES (1)..(1): Xaa is selected from the group consisting of Val, Trp, Tyr, and Phe
  MOD_RES (2)..(2): Xaa is selected from the group consisting of Asp, Gln, and Ser
  MOD_RES (3)..(3): Xaa is selected from the group consisting of Glu, Thr, Ans, and Ser
  MOD_RES (5)..(5): Xaa is selected from the group consisting of Leu, Pro, Lys, Ser, Trp, Val, Asn and Gln
  MOD_RES (9)..(9): Xaa is selected from the group consisting of Leu, Trp, Val, Ala, Met, Thr, and Ser
  MOD_RES (10)..(10): Xaa is selected from the group consisting of Thr, Phe, Val, Arg, Ala, Asp, Leu, Glu, Ser, and Tyr
  MOD_RES (13)..(13): Xaa is selected from the group consisting of Asn, Pro, Phe, His, Lys, and Tyr
  MOD_RES (14)..(14): Xaa is selected from the group consisting of Met, Asp, Glu, Val, Gly, and Lys
  MOD_RES (20)..(20): Xaa is selected from the group consisting of Gln, Ile, Gle, Trp, Arg, Leu, and Asn
XXXKXNVFXXGYXXRLRAKX

SEQ ID NO: 3 - protein, 25 aa, Artificial Sequence
  Synthetic peptide
TFVDERLLYFLTIGNMGMYAAQLKF

SEQ ID NO: 4 - protein, 18 aa, Artificial Sequence
  Synthetic peptide
VIVFTFRHNKLIGYERRY

SEQ ID NO: 5 - protein, 27 aa, Artificial Sequence
  Synthetic peptide
GVWQTHPRYFWTMWPDIKGEVIVLFGT

SEQ ID NO: 6 - protein, 20 aa, Artificial Sequence
  Synthetic peptide
KWFCGMRDMKGTMSCVWVKF

SEQ ID NO: 7 - protein, 19 aa, Artificial Sequence
  Synthetic peptide
ASFPLAVQLHVSKRSKEMA

SEQ ID NO: 8 - protein, 35 aa, Artificial Sequence
  Synthetic peptide
  MOD_RES (1)..(1): N-terminal acetylation
  MOD_RES (35)..(35): C-terminal amidation
KKSGVGRLQVAFQSKKNVFVFGYFERLRAKLTSKK

SEQ ID NO: 9 - protein, 32 aa, Artificial Sequence
  Synthetic peptide
  MOD_RES (1)..(1): N-terminal acetylation
  MOD_RES (32)..(32): C-terminal amidation
KKSGVGRLQVAFQSKKNVFVFGYFERLRAKKK

SEQ ID NO: 10 - protein, 32 aa, Artificial Sequence
  Synthetic peptide
  MOD_RES (1)..(1): N-terminal acetylation
  MOD_RES (32)..(32): C-terminal amidation
KKGRLQVAFQSKKNVFVFGYFERLRAKLTSKK

SEQ ID NO: 11 - protein, 29 aa, Artificial Sequence
  Synthetic peptide
  MOD_RES (1)..(1): N-terminal acetylation
  MOD_RES (29)..(29): C-terminal amidation
KKQVAFQSKKNVFVFGYFERLRAKLTSKK

SEQ ID NO: 12 - protein, 26 aa, Artificial Sequence
  Synthetic peptide
  MOD_RES (1)..(1): N-terminal acetylation
  MOD_RES (26)..(26): C-terminal amidation
KKFQSKKNVFVFGYFERLRAKLTSKK

SEQ ID NO: 13 - protein, 24 aa, Artificial Sequence
  Synthetic peptide
  MOD_RES (1)..(1): N-terminal acetylation
  MOD_RES (24)..(24): C-terminal amidation
KKFQSKKNVFVFGYFERLRAKLKK

SEQ ID NO: 14 - protein, 25 aa, Artificial Sequence
  Synthetic peptide
  MOD_RES (1)..(1): N-terminal acetylation
  MOD_RES (25)..(25): C-terminal amidation
KKAFQSKKNVFVFGYFERLRAKLKK

SEQ ID NO: 15 - protein, 36 aa, Artificial Sequence
  Synthetic peptide
  MOD_RES (1)..(1): N-terminal acetylation
  MOD_RES (2)..(2): Xaa is Carboxyfluorescein
  MOD_RES (36)..(36): C-terminal amidation
KXKSGVGRLQVAFQSKKNVFVFGYFERLRAKLTSKK

SEQ ID NO: 16 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFDRLRAKL

SEQ ID NO: 17 - protein, 20 aa, Artificial Sequence
  Synthetic peptide
  MOD_RES (1)..(1): N-terminal acetylation
  MOD_RES (20)..(20): C-terminal amidation
FQSKNNVFVQGYFDRLRAKL

SEQ ID NO: 18 - protein, 20 aa, Artificial Sequence
  Synthetic peptide
  MOD_RES (1)..(1): N-terminal acetylation
  MOD_RES (20)..(20): C-terminal amidation
FQSKNNVFVSGYFDRLRAKL

SEQ ID NO: 19 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFERLRAKL

SEQ ID NO: 20 - protein, 20 aa, Artificial Sequence
  Synthetic peptide
  MOD_RES (1)..(1): N-terminal acetylation
  MOD_RES (20)..(20): C-terminal amidation
FQSKDNVFVFGYFERLRAKL

SEQ ID NO: 21 - protein, 20 aa, Artificial Sequence
  Synthetic peptide
  MOD_RES (1)..(1): N-terminal acetylation
  MOD_RES (20)..(20): C-terminal amidation
FQSKKNVFVEGYFERLRAKL

SEQ ID NO: 22 - protein, 20 aa, Artificial Sequence
  Synthetic peptide
  MOD_RES (1)..(1): N-terminal acetylation
  MOD_RES (20)..(20): C-terminal amidation
FQSKKNVFVTGYFERLRAKL

SEQ ID NO: 23 - protein, 20 aa, Artificial Sequence
  Synthetic peptide
  MOD_RES (1)..(1): N-terminal acetylation
  MOD_RES (20)..(20): C-terminal amidation
FQSKKNVFVHGYFERLRAKL

SEQ ID NO: 24 - protein, 20 aa, Artificial Sequence
  Synthetic peptide
  MOD_RES (1)..(1): N-terminal acetylation
  MOD_RES (20)..(20): C-terminal amidation
FQSKKNVFVMGYFERLRAKL

SEQ ID NO: 25 - protein, 20 aa, Artificial Sequence
  Synthetic peptide
  MOD_RES (1)..(1): N-terminal acetylation
  MOD_RES (20)..(20): C-terminal amidation
FQSKKNVFVNGYFERLRAKL

SEQ ID NO: 26 - protein, 20 aa, Artificial Sequence
  Synthetic peptide
  MOD_RES (1)..(1): N-terminal acetylation
  MOD_RES (20)..(20): C-terminal amidation
FQSKGNVFVTGYFERLRAKL

SEQ ID NO: 27 - protein, 20 aa, Artificial Sequence
  Synthetic peptide
  MOD_RES (1)..(1): N-terminal acetylation
  MOD_RES (20)..(20): C-terminal amidation
FQSKGNVFVNGYFERLRAKL

SEQ ID NO: 28 - protein, 20 aa, Artificial Sequence
  Synthetic peptide
  MOD_RES (1)..(1): N-terminal acetylation
  MOD_RES (20)..(20): C-terminal amidation
FQSKGNVFVHGYFERLRAKL

SEQ ID NO: 29 - protein, 20 aa, Artificial Sequence
  Synthetic peptide
  MOD_RES (1)..(1): N-terminal acetylation
  MOD_RES (20)..(20): C-terminal amidation
FQSKGNVFVKGYFERLRAKL

SEQ ID NO: 30 - protein, 20 aa, Artificial Sequence
  Synthetic peptide
  MOD_RES (1)..(1): N-terminal acetylation
  MOD_RES (20)..(20): C-terminal amidation
FQSKGNVFVEGYFERLRAKL

SEQ ID NO: 31 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFDRLRAKL

SEQ ID NO: 32 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKL

SEQ ID NO: 33 - protein, 20 aa, Artificial Sequence
  Synthetic peptide
  MOD_RES (1)..(1): N-terminal acetylation
  MOD_RES (20)..(20): C-terminal amidation
FQSKDNVFVTGYFERLRAKL

SEQ ID NO: 34 - protein, 20 aa, Artificial Sequence
  Synthetic peptide
  MOD_RES (1)..(1): N-terminal acetylation
  MOD_RES (20)..(20): C-terminal amidation
FQSKDNVFVNGYFERLRAKL

SEQ ID NO: 35 - protein, 20 aa, Artificial Sequence
  Synthetic peptide
  MOD_RES (1)..(1): N-terminal acetylation
  MOD_RES (20)..(20): C-terminal amidation
FQSKDNVFVHGYFERLRAKL

SEQ ID NO: 36 - protein, 20 aa, Artificial Sequence
  Synthetic peptide
  MOD_RES (1)..(1): N-terminal acetylation
  MOD_RES (20)..(20): C-terminal amidation
FQSKDNVFVKGYFERLRAKL

SEQ ID NO: 37 - protein, 20 aa, Artificial Sequence
  Synthetic peptide
  MOD_RES (1)..(1): N-terminal acetylation
  MOD_RES (20)..(20): C-terminal amidation
FQSKDNVFVEGYFERLRAKL

SEQ ID NO: 38 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLRAKL

SEQ ID NO: 39 - protein, 20 aa, Artificial Sequence
  Synthetic peptide
  MOD_RES (1)..(1): N-terminal acetylation
  MOD_RES (20)..(20): C-terminal amidation
FQSKNNVFVTGYFERLRAKL

SEQ ID NO: 40 - protein, 20 aa, Artificial Sequence
  Synthetic peptide
  MOD_RES (1)..(1): N-terminal acetylation
  MOD_RES (20)..(20): C-terminal amidation
FQSKNNVFVNGYFERLRAKL

SEQ ID NO: 41 - protein, 20 aa, Artificial Sequence
  Synthetic peptide
  MOD_RES (1)..(1): N-terminal acetylation
  MOD_RES (20)..(20): C-terminal amidation
FQSKNNVFVHGYFERLRAKL

SEQ ID NO: 42 - protein, 20 aa, Artificial Sequence
  Synthetic peptide
  MOD_RES (1)..(1): N-terminal acetylation
  MOD_RES (20)..(20): C-terminal amidation
FQSKNNVFVKGYFERLRAKL

SEQ ID NO: 43 - protein, 20 aa, Artificial Sequence
  Synthetic peptide
  MOD_RES (1)..(1): N-terminal acetylation
  MOD_RES (20)..(20): C-terminal amidation
FQSKNNVFVEGYFERLRAKL

SEQ ID NO: 44 - protein, 20 aa, Artificial Sequence
  Synthetic peptide
  MOD_RES (1)..(1): N-terminal acetylation
  MOD_RES (20)..(20): C-terminal amidation
FQSKQNVFVTGYFERLRAKL

SEQ ID NO: 45 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLRAKL

SEQ ID NO: 46 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVFGYFERLRAKL

SEQ ID NO: 47 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVDGYFARLRAKL

SEQ ID NO: 48 - protein, 20 aa, Artificial Sequence
  Synthetic peptide
  MOD_RES (1)..(1): N-terminal acetylation
  MOD_RES (20)..(20): C-terminal amidation
FQSKGNVHVKGYFERLRAKL

SEQ ID NO: 49 - protein, 20 aa, Artificial Sequence
  Synthetic peptide
  MOD_RES (1)..(1): N-terminal acetylation
  MOD_RES (20)..(20): C-terminal amidation
FQSKGNVHVDGYFERLRAKL

SEQ ID NO: 50 - protein, 20 aa, Artificial Sequence
  Synthetic peptide
  MOD_RES (1)..(1): N-terminal acetylation
  MOD_RES (20)..(20): C-terminal amidation
FQSPGNVHVKGYFERLRAKL

SEQ ID NO: 51 - protein, 20 aa, Artificial Sequence
  Synthetic peptide
  MOD_RES (1)..(1): N-terminal acetylation
  MOD_RES (20)..(20): C-terminal amidation
FQSPGNVHVDGYFERLRAKL

SEQ ID NO: 52 - protein, 20 aa, Artificial Sequence
  Synthetic peptide
  MOD_RES (1)..(1): N-terminal acetylation
  MOD_RES (20)..(20): C-terminal amidation
FQSKGNIFVFGYFERLRAKL

SEQ ID NO: 53 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVFGYFERLRAKL

SEQ ID NO: 54 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVTGYFARLRAKL

SEQ ID NO: 55 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVDGYFARLRAKL

SEQ ID NO: 56 - protein, 20 aa, Artificial Sequence
  Synthetic peptide
  MOD_RES (1)..(1): N-terminal acetylation
  MOD_RES (17)..(17): Xaa is (S)-Diaminopropionic acid
  MOD_RES (20)..(20): C-terminal amidation
FQSKGNVFVDGYFERLXAKL

SEQ ID NO: 57 - protein, 20 aa, Artificial Sequence
  Synthetic peptide
  MOD_RES (1)..(1): N-terminal acetylation
  MOD_RES (1)..(1): (S)-Ornithine
  misc_feature (17)..(17): Xaa can be any naturally occurring amino acid
  MOD_RES (20)..(20): C-terminal amidation
FQSKGNVFVDGYFERLXAKL

SEQ ID NO: 58 - protein, 20 aa, Artificial Sequence
  Synthetic peptide
  MOD_RES (1)..(1): N-terminal acetylation
  MOD_RES (17)..(17): Xaa is (S)-2-Amino-pentanoic acid
  MOD_RES (20)..(20): C-terminal amidation
FQSKGNVFVDGYFERLXAKL

SEQ ID NO: 59 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVAGYFERLRAKL

SEQ ID NO: 60 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVDGYFARLRAKL

SEQ ID NO: 61 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVDGYFERLRAKL

SEQ ID NO: 62 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVTGYFARLRAKL

SEQ ID NO: 63 - protein, 20 aa, Artificial Sequence
  Synthetic peptide
  MOD_RES (1)..(1): N-terminal acetylation
  MOD_RES (17)..(17): (S)-Homo-Citrulline
  MOD_RES (20)..(20): C-terminal amidation
FQSKGNVFVDGYFERLXAKL

SEQ ID NO: 64 - protein, 20 aa, Artificial Sequence
  Synthetic peptide
  MOD_RES (1)..(1): N-terminal acetylation
  MOD_RES (17)..(17): (S)-Homo-Arg
  MOD_RES (20)..(20): C-terminal amidation
FQSKGNVFVDGYFERLRAKL

SEQ ID NO: 65 - protein, 20 aa, Artificial Sequence
  Synthetic peptide
  MOD_RES (1)..(1): N-terminal acetylation
  MOD_RES (17)..(17): (S)-2-Pyridyl-Ala
  MOD_RES (20)..(20): C-terminal amidation
FQSKGNVFVDGYFERLAAKL

SEQ ID NO: 66 - protein, 20 aa, Artificial Sequence
  Synthetic peptide
  MOD_RES (1)..(1): N-terminal acetylation
  MOD_RES (17)..(17): Xaa is 2-Amino-isobutryic acid
  MOD_RES (20)..(20): C-terminal amidation
FQSKGNVFVDGYFERLXAKL

SEQ ID NO: 67 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVTGYFARLRAKL

SEQ ID NO: 68 - protein, 20 aa, Artificial Sequence
  Synthetic peptide
  MOD_RES (1)..(1): N-terminal acetylation
  MOD_RES (17)..(17): (S)-N(omega)-nitro-Arg
  MOD_RES (20)..(20): C-terminal amidation
FQSKGNVFVDGYFERLRAKL

SEQ ID NO: 69 - protein, 20 aa, Artificial Sequence
  Synthetic peptide
  MOD_RES (1)..(1): N-terminal acetylation
  MOD_RES (20)..(20): C-terminal amidation
FQSKGNVFVTGYFDRLRAKL

SEQ ID NO: 70 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVFGYFARLRAKL

SEQ ID NO: 71 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is (S)-Norleucine
  MOD_RES (20)..(20): C-terminal amidation
FQSKGNVFVDGYFERLXAKL

SEQ ID NO: 72 - protein, 20 aa, Artificial Sequence
  Synthetic peptide
  MOD_RES (1)..(1): N-terminal acetylation
  MOD_RES (20)..(20): C-terminal amidation
FQSKGAVFVDGYFERLRAKL

SEQ ID NO: 73 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFARLRAKL

SEQ ID NO: 74 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVAGYFARLRAKL

SEQ ID NO: 75 - protein, 20 aa, Artificial Sequence
  Synthetic peptide
  MOD_RES (1)..(1): N-terminal acetylation
  MOD_RES (20)..(20): C-terminal amidation
FQSEGNVFVDGYFERLRAKL

SEQ ID NO: 76 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLHAKL

SEQ ID NO: 77 - protein, 20 aa, Artificial Sequence
  Synthetic peptide
  MOD_RES (1)..(1): N-terminal acetylation
  MOD_RES (20)..(20): C-terminal amidation
FQSIGNVFVDGYFERLRAKL

SEQ ID NO: 78 - protein, 20 aa, Artificial Sequence
  Synthetic peptide
  MOD_RES (1)..(1): N-terminal acetylation
  MOD_RES (20)..(20): C-terminal amidation
FQSKGNIFVDGYFERLRAKL

SEQ ID NO: 79 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVTGYFERLRAKL

SEQ ID NO: 80 - protein, 20 aa, Artificial Sequence
  Synthetic peptide
  MOD_RES (1)..(1): N-terminal acetylation
  MOD_RES (20)..(20): C-terminal amidation
FQSKGKVFVDGYFERLRAKL

SEQ ID NO: 81 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLKAKL

SEQ ID NO: 82 - protein, 20 aa, Artificial Sequence
  Synthetic peptide
  MOD_RES (1)..(1): N-terminal acetylation
  MOD_RES (17)..(17): (S)-2-Propargylglycine
  MOD_RES (20)..(20): C-terminal amidation
FQSKGNVFVDGYFERLGAKL

SEQ ID NO: 83 - protein, 20 aa, Artificial Sequence
  Synthetic peptide
  MOD_RES (1)..(1): N-terminal acetylation
  MOD_RES (20)..(20): C-terminal amidation
FQSLGNVFVDGYFERLRAKL

SEQ ID NO: 84 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFLRLRAKL

SEQ ID NO: 85 - protein, 20 aa, Artificial Sequence
  Synthetic peptide
  MOD_RES (1)..(1): N-terminal acetylation
  MOD_RES (17)..(17): Xaa is (S)-2,4-Diaminobutyric acid
  MOD_RES (20)..(20): C-terminal amidation
FQSKGNVFVDGYFERLXAKL

SEQ ID NO: 86 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLLAKL

SEQ ID NO: 87 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRLKL

SEQ ID NO: 88 - protein, 20 aa, Artificial Sequence
  Synthetic peptide
  MOD_RES (1)..(1): N-terminal acetylation
  MOD_RES (20)..(20): C-terminal amidation
MQSKGNVFVDGYFERLRAKL

SEQ ID NO: 89 - protein, 20 aa, Artificial Sequence
  Synthetic peptide
  MOD_RES (1)..(1): N-terminal acetylation
  MOD_RES (20)..(20): C-terminal amidation
FQMKGNVFVDGYFERLRAKL

SEQ ID NO: 90 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFMRLRAKL

SEQ ID NO: 91 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRMKL

SEQ ID NO: 92 - protein, 20 aa, Artificial Sequence
  Synthetic peptide
  MOD_RES (1)..(1): N-terminal acetylation
  MOD_RES (17)..(17): (S)-Cyclohexylalanine
  MOD_RES (20)..(20): C-terminal amidation
FQSKGNVFVDGYFERLAAKL

SEQ ID NO: 93 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFNRLRAKL

SEQ ID NO: 94 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRNKL

SEQ ID NO: 95 - protein, 20 aa, Artificial Sequence
  Synthetic peptide
  MOD_RES (1)..(1): N-terminal acetylation
  MOD_RES (20)..(20): C-terminal amidation
FQSPGNVFVDGYFERLRAKL

SEQ ID NO: 96 - protein, 20 aa, Artificial Sequence
  Synthetic peptide
  MOD_RES (1)..(1): N-terminal acetylation
  MOD_RES (17)..(17): (S)-2-Amino-5-methyl-hexanoic acid
  MOD_RES (20)..(20): C-terminal amidation
FQSKGNVFVDGYFERLXAKL

SEQ ID NO: 97 - protein, 20 aa, Artificial Sequence
  Synthetic peptide
  MOD_RES (1)..(1): N-terminal acetylation
  MOD_RES (20)..(20): C-terminal amidation
FQQKGNVFVDGYFERLRAKL

SEQ ID NO: 98 - protein, 20 aa, Artificial Sequence
  Synthetic peptide
  MOD_RES (1)..(1): N-terminal acetylation
  MOD_RES (20)..(20): C-terminal amidation
FQSKGQVFVDGYFERLRAKL

SEQ ID NO: 99 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFQRLRAKL

SEQ ID NO: 100 - protein, 20 aa, Artificial Sequence
  Synthetic peptide
  MOD_RES (1)..(1): N-terminal acetylation
  MOD_RES (20)..(20): C-terminal amidation
FQRKGNVFVDGYFERLRAKL

SEQ ID NO: 101 - protein, 20 aa, Artificial Sequence
  Synthetic peptide
  MOD_RES (1)..(1): N-terminal acetylation
  MOD_RES (20)..(20): C-terminal amidation
FQSRGNVFVDGYFERLRAKL

SEQ ID NO: 102 - protein, 20 aa, Artificial Sequence
  Synthetic peptide
  MOD_RES (1)..(1): N-terminal acetylation
  MOD_RES (20)..(20): C-terminal amidation
FQSKGRVFVDGYFERLRAKL

SEQ ID NO: 103 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFRRLRAKL

SEQ ID NO: 104 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKGNVFVDGYFERLXAKL

SEQ ID NO: 105 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRRKL

SEQ ID NO: 106 - protein, 20 aa, Artificial Sequence
  Synthetic peptide
  MOD_RES (1)..(1): N-terminal acetylation
  MOD_RES (5)..(5): D-Ala
  MOD_RES (17)..(17): Xaa is Norleucine
  MOD_RES (20)..(20): C-terminal amidation
FQSKANVFVDGYFERLXAKL

SEQ ID NO: 107 - protein, 20 aa, Artificial Sequence
  Synthetic peptide
  MOD_RES (1)..(1): N-terminal acetylation
  MOD_RES (20)..(20): C-terminal amidation
FQSKGSVFVDGYFERLRAKL

SEQ ID NO: 108 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFTRLRAKL

SEQ ID NO: 109 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVAGYFARLRAKL

SEQ ID NO: 110 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFVRLRAKL

SEQ ID NO: 111 - protein, 20 aa, Artificial Sequence
  Synthetic peptide
  MOD_RES (1)..(1): N-terminal acetylation
  MOD_RES (20)..(20): C-terminal amidation
YQSKGNVFVDGYFERLRAKL

SEQ ID NO: 112 - protein, 20 aa, Artificial Sequence
  Synthetic peptide
  MOD_RES (1)..(1): N-terminal acetylation
  MOD_RES (20)..(20): C-terminal amidation
FQSKGNVYVDGYFERLRAKL

SEQ ID NO: 113 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKGNVFVDGYFARLXAKL

SEQ ID NO: 114 - protein, 20 aa, Artificial Sequence
  Synthetic peptide
  MOD_RES (1)..(1): N-terminal Carboxyfluorescein
  MOD_RES (20)..(20): C-terminal amidation
FQSKGNVFVDGYFERLRAKL

SEQ ID NO: 115 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVDGYFARLRAKL

SEQ ID NO: 116 - protein, 20 aa, Artificial Sequence
  Synthetic peptide
  MOD_RES (1)..(1): N-terminal acetylation
  MOD_RES (20)..(20): C-terminal amidation
FQSKGAVFVDGYFARLRAKL

SEQ ID NO: 117 - protein, 20 aa, Artificial Sequence
  Synthetic peptide
  MOD_RES (1)..(1): N-terminal acetylation
  MOD_RES (5)..(5): D-Asp
  MOD_RES (20)..(20): C-terminal amidation
FQSKDAVFVDGYFARLRAKL

SEQ ID NO: 118 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVAGYFARLRAKL

SEQ ID NO: 119 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKDAVFVAGYFARLRAKL

SEQ ID NO: 120 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVKGYFARLRAKL

SEQ ID NO: 121 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKDAVFVKGYFARLRAKL

SEQ ID NO: 122 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVTGYFARLRAKL

SEQ ID NO: 123 - protein, 20 aa, Artificial Sequence
  Synthetic peptide
  MOD_RES (1)..(1): N-terminal acetylation
  MOD_RES (5)..(5): D-Asp
  MOD_RES (20)..(20): C-terminal amidation
FQSKDAVFVTGYFARLRAKL

SEQ ID NO: 124 - protein, 21 aa, Artificial Sequence
  Synthetic peptide
  MOD_RES (1)..(1): N-terminal Carboxyfluorescein
  MOD_RES (1)..(1): Xaa is (13-Amino-4,7,10-trioxa-tridecayl)-succinamic acid
  MOD_RES (21)..(21): C-terminal amidation
XFQSKGNVFVDGYFERLRAKL

SEQ ID NO: 125 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVTGYFERLRAKL

SEQ ID NO: 126 - protein, 20 aa, Artificial Sequence
  Synthetic peptide
  MOD_RES (1)..(1): N-terminal acetylation
  MOD_RES (5)..(5): D-Ala
  MOD_RES (17)..(17): Xaa is Norleucine
  MOD_RES (20)..(20): C-terminal amidation
FQSKANVFVDGYFARLXAKL

SEQ ID NO: 127 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVAGYFARLRAKL

SEQ ID NO: 128 - protein, 20 aa, Artificial Sequence
  Synthetic peptide
  MOD_RES (1)..(1): N-terminal acetylation
  MOD_RES (5)..(5): D-Pro
  MOD_RES (20)..(20): C-terminal N-ethyl
FQSKGNVFVFGYFERLRAKL

SEQ ID NO: 129 - protein, 20 aa, Artificial Sequence
  Synthetic peptide
  MOD_RES (1)..(1): N-terminal acetylation
  MOD_RES (20)..(20): C-terminal amidation
FQSKPNVFVFGYFERLRAKL

SEQ ID NO: 130 - protein, 21 aa, Artificial Sequence
  Synthetic peptide
  MOD_RES (1)..(1): N-terminal acetylation
  MOD_RES (21)..(21): C-terminal amidation
FQSKGNVFVDGYFERLRAKLC

SEQ ID NO: 131 - protein, 20 aa, Artificial Sequence
  Synthetic peptide
  MOD_RES (1)..(1): N-terminal acetylation
  MOD_RES (20)..(20): C-terminal amidation
FQSKGNVFVSGYFERLRAKL

SEQ ID NO: 132 - protein, 20 aa, Artificial Sequence
  Synthetic peptide
  MOD_RES (1)..(1): N-terminal acetylation
  MOD_RES (20)..(20): C-terminal amidation
FQSKGNVFVVGYFERLRAKL

SEQ ID NO: 133 - protein, 20 aa, Artificial Sequence
  Synthetic peptide
  MOD_RES (1)..(1): N-terminal acetylation
  MOD_RES (20)..(20): C-terminal amidation
FQSKHHVFVDGYFERLAAKL

SEQ ID NO: 134 - protein, 20 aa, Artificial Sequence
  Synthetic peptide
  MOD_RES (1)..(1): N-terminal acetylation
  MOD_RES (20)..(20): C-terminal amidation
FQSRRGVFVDGYFERLAAKL

SEQ ID NO: 135 - protein, 20 aa, Artificial Sequence
  Synthetic peptide
  MOD_RES (1)..(1): N-terminal acetylation
  MOD_RES (20)..(20): C-terminal amidation
FQCKGNVFVDGYFERLRAKL

SEQ ID NO: 136 - protein, 20 aa, Artificial Sequence
  Synthetic peptide
  MOD_RES (1)..(1): N-terminal acetylation
  MOD_RES (20)..(20): C-terminal amidation
FQSKGCVFVDGYFERLRAKL

SEQ ID NO: 137 - protein, 20 aa, Artificial Sequence
  Synthetic peptide
  MOD_RES (1)..(1): N-terminal acetylation
  MOD_RES (20)..(20): C-terminal amidation
FQSKGNVFVDGYCERLRAKL

SEQ ID NO: 138 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFCRLRAKL

SEQ ID NO: 139 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLCAKL

SEQ ID NO: 140 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLCAKL

SEQ ID NO: 141 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFMRLCAKL

SEQ ID NO: 142 - protein, 20 aa, Artificial Sequence
  Synthetic peptide
  MOD_RES (1)..(1): N-terminal acetylation
  MOD_RES (20)..(20): C-terminal amidation
FQSKDNVFVHGYFERLCAKL

SEQ ID NO: 143 - protein, 20 aa, Artificial Sequence
  Synthetic peptide
  MOD_RES (1)..(1): N-terminal acetylation
  MOD_RES (20)..(20): C-terminal amidation
YQSKNNVFVDGYFERLCAKL

SEQ ID NO: 144 - protein, 20 aa, Artificial Sequence
  Synthetic peptide
  MOD_RES (1)..(1): N-terminal acetylation
  MOD_RES (20)..(20): C-terminal amidation
FQSKGHVFVDGYFERLCAKL

SEQ ID NO: 145 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLCAKL

SEQ ID NO: 146 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLCAKL

SEQ ID NO: 147 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLCAKL

SEQ ID NO: 148 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLCAKL

SEQ ID NO: 149 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFERLCAKL

SEQ ID NO: 150 - protein, 20 aa, Artificial Sequence
  Synthetic peptide
  MOD_RES (1)..(1): N-terminal acetylation
  MOD_RES (20)..(20): C-terminal amidation
FQSKDHVFVDGYFERLCAKL

SEQ ID NO: 151 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLCAKL

SEQ ID NO: 152 - protein, 20 aa, Artificial Sequence
  Synthetic peptide
  MOD_RES (1)..(1): N-terminal acetylation
  MOD_RES (20)..(20): C-terminal amidation
FQSKHHVFVDGYFERLCAKL

SEQ ID NO: 153 - protein, 20 aa, Artificial Sequence
  Synthetic peptide
  MOD_RES (1)..(1): N-terminal acetylation
  MOD_RES (20)..(20): C-terminal amidation
FQSKHNVYVDGYFERLCAKL

SEQ ID NO: 154 - protein, 20 aa, Artificial Sequence
  Synthetic peptide
  MOD_RES (1)..(1): N-terminal acetylation
  MOD_RES (20)..(20): C-terminal amidation
FQSRRGVFVDGYFERLCAKL

SEQ ID NO: 155 - protein, 20 aa, Artificial Sequence
  Synthetic peptide
  MOD_RES (1)..(1): N-terminal acetylation
  MOD_RES (20)..(20): C-terminal amidation
YQSKQNVFVDGYFERLCAKL

SEQ ID NO: 156 - protein, 20 aa, Artificial Sequence
  Synthetic peptide
  MOD_RES (1)..(1): N-terminal acetylation
  MOD_RES (20)..(20): C-terminal amidation
FQSEHNVFVDGYFERLCAKL

SEQ ID NO: 157 - protein, 20 aa, Artificial Sequence
  Synthetic peptide
  MOD_RES (1)..(1): N-terminal acetylation
  MOD_RES (20)..(20): C-terminal amidation
FQSKNDVFVDGYFERLCAKL

SEQ ID NO: 158 - protein, 20 aa, Artificial Sequence
  Synthetic peptide
  MOD_RES (1)..(1): N-terminal acetylation
  MOD_RES (20)..(20): C-terminal amidation
FQSKRNVFVDGYFERLCAKL

SEQ ID NO: 159 - protein, 20 aa, Artificial Sequence
  Synthetic peptide
  MOD_RES (1)..(1): N-terminal acetylation
  MOD_RES (20)..(20): C-terminal amidation
FQSPKNVFVDGYFERLCAKL

SEQ ID NO: 160 - protein, 20 aa, Artificial Sequence
  Synthetic peptide
  MOD_RES (1)..(1): N-terminal acetylation
  MOD_RES (20)..(20): C-terminal amidation
FQSGKNVFVDGYFERLCAKL

SEQ ID NO: 161 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVAGYFERLRAKL

SEQ ID NO: 162 - protein, 20 aa, Artificial Sequence
  Synthetic peptide
  MOD_RES (1)..(1): N-terminal acetylation
  MOD_RES (4)..(4): Xaa is 2-Amino-isobutyric acid
  MOD_RES (17)..(17): Xaa is 2-Amino-isobutyric acid
  MOD_RES (20)..(20): C-terminal amidation
FQSXGNVFVDGYFERLXAKL

SEQ ID NO: 163 - protein, 20 aa, Artificial Sequence
  Synthetic peptide
  MOD_RES (1)..(1): N-terminal acetylation
  MOD_RES (5)..(5): Xaa is 2-Amino-isobutyric acid
  MOD_RES (17)..(17): Xaa is 2-Amino-isobutyric acid
  MOD_RES (20)..(20): C-terminal amidation
FQSKXNVFVDGYFERLXAKL

SEQ ID NO: 164 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is 2-Amino-isobutyric acid
  MOD_RES (20)..(20): C-terminal amidation
FQSKGNVFVDGYFERLXAKL

SEQ ID NO: 165 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is 2-Amino-isobutyric acid
  MOD_RES (20)..(20): C-terminal amidation
FQSKGNVFVTGYFERLXAKL

SEQ ID NO: 166 - protein, 20 aa, Artificial Sequence
  Synthetic peptide
  MOD_RES (1)..(1): N-terminal Aminooxy acetate
  MOD_RES (17)..(17): Xaa is 2-Amino-isobutyric acid
  MOD_RES (20)..(20): C-terminal amidation
FQSKGNVFVDGYFERLXAKL

SEQ ID NO: 167 - protein, 21 aa, Artificial Sequence
  Synthetic peptide
  MOD_RES (1)..(1): N-terminal acetylation
  DISULFID (14)..(21): Cys residues linked via disulfide bond
  MOD_RES (17)..(17): Xaa is 2-Amino-isobutyric acid
  MOD_RES (21)..(21): C-terminal amidation
FQSKGNVFVDGYFERLXAKLC

SEQ ID NO: 168 - protein, 21 aa, Artificial Sequence
  Synthetic peptide
  MOD_RES (1)..(1): N-terminal acetylation
  DISULFID (14)..(21): Cys residues linked via disulfide bond
  MOD_RES (17)..(17): Xaa is 2-Amino-isobutryic acid
  MOD_RES (20)..(20): C-terminal amidation
FQSKGNVFVDGYFCRLXAKLC

SEQ ID NO: 169 - protein, 20 aa, Artificial Sequence
  Synthetic peptide
  MOD_RES (1)..(1): N-terminal acetylation
  MOD_RES (20)..(20): C-terminal amidation
FQSKGNIFVDGYFERLHAKL

SEQ ID NO: 170 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFKRLRAKL

SEQ ID NO: 171 - protein, 20 aa, Artificial Sequence
  Synthetic peptide
  MOD_RES (1)..(1): N-terminal acetylation
  MOD_RES (20)..(20): C-terminal amidation
YQTKGNVFVDGYFERLRAKL

SEQ ID NO: 172 - protein, 20 aa, Artificial Sequence
  Synthetic peptide
  MOD_RES (1)..(1): N-terminal acetylation
  MOD_RES (20)..(20): C-terminal amidation
FQTKDNVHVDGYFERLRAKL

SEQ ID NO: 173 - protein, 20 aa, Artificial Sequence
  Synthetic peptide
  MOD_RES (1)..(1): N-terminal acetylation
  MOD_RES (20)..(20): C-terminal amidation
LQQKGNVFVDGYFERLRAKL

SEQ ID NO: 174 - protein, 20 aa, Artificial Sequence
  Synthetic peptide
  MOD_RES (1)..(1): N-terminal pegylation
  MOD_RES (17)..(17): Xaa is 2-Amino-isobutyric acid
  MOD_RES (20)..(20): C-terminal amidation
FQSKGNVFVDGYFERLXAKL

SEQ ID NO: 175 - protein, 20 aa, Artificial Sequence
  Synthetic peptide
  MOD_RES (1)..(1): N-terminal pegylation
  MOD_RES (17)..(17): Xaa is 2-Amino-isobutyric acid
  MOD_RES (20)..(20): C-terminal amidation
FQSKGNVFVDGYFERLXAKL

SEQ ID NO: 176 - protein, 21 aa, Artificial Sequence
  Synthetic peptide
  MOD_RES (1)..(1): N-terminal acetylation
  MOD_RES (17)..(17): Xaa is 2-Amino-isobutyric acid
  MOD_RES (21)..(21): PEGYLATION
  MOD_RES (21)..(21): C-terminal amidation
FQSKGNVFVDGYFERLXAKLC

SEQ ID NO: 177 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-Amino-isobutyric acid
  MOD_RES (20)..(20): C-terminal amidation
FQSKPNVFVDGYFERLXAKL

SEQ ID NO: 178 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-Amino-isobutyric acid
  MOD_RES (20)..(20): C-terminal amidation
FQSKPNVHVDGYFERLXAKL

SEQ ID NO: 179 - protein, 21 aa, Artificial Sequence
  Synthetic peptide
  MOD_RES (1)..(1): N-terminal acetylation
  MOD_RES (21)..(21): C-terminal amidation
PFQSKGNVFVDGYFERLRAKL

SEQ ID NO: 180 - protein, 22 aa, Artificial Sequence
  Synthetic peptide
  MOD_RES (1)..(1): N-terminal acetylation
  MOD_RES (20)..(20): C-terminal amidation
PEFQSKGNVFVDGYFERLRAKL

SEQ ID NO: 181 - protein, 21 aa, Artificial Sequence
  Synthetic peptide
  MOD_RES (1)..(1): N-terminal acetylation
  MOD_RES (6)..(6): (S)-N-methyl-Glu
  MOD_RES (18)..(18): Xaa is 2-Amino-isobutyric acid
  MOD_RES (21)..(21): C-terminal amidation
PFQSKENVFVDGYFERLXAKL

SEQ ID NO: 182 - protein, 26 aa, Artificial Sequence
  Synthetic peptide
  MOD_RES (1)..(1): N-terminal acetylation
  MOD_RES (26)..(26): C-terminal amidation
KKAFQSKKNVFVFGYFERLRAKLTKK

SEQ ID NO: 183 - protein, 20 aa, Artificial Sequence
  Synthetic peptide
  MOD_RES (1)..(1): N-terminal acetylation
  MOD_RES (20)..(20): C-terminal amidation
FQSKNNVFVFGYFERLRAKL

SEQ ID NO: 184 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLRAKL

SEQ ID NO: 185 - protein, 20 aa, Artificial Sequence
  Synthetic peptide
  MOD_RES (1)..(1): N-terminal acetylation
  MOD_RES (20)..(20): C-terminal amidation
FQSKKNVFVSGYFERLRAKL

SEQ ID NO: 186 - protein, 20 aa, Artificial Sequence
  Synthetic peptide
  MOD_RES (1)..(1): N-terminal acetylation
  MOD_RES (20)..(20): C-terminal amidation
FQSKNNVFVYGYFDRLRAKL

SEQ ID NO: 187 - protein, 20 aa, Artificial Sequence
  Synthetic peptide
  MOD_RES (1)..(1): N-terminal acetylation
  MOD_RES (20)..(20): C-terminal amidation
FQSKNNVFVFGYFDRLRAKL

SEQ ID NO: 188 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFDRLRAKL

SEQ ID NO: 189 - protein, 20 aa, Artificial Sequence
  Synthetic peptide
  MOD_RES (1)..(1): N-terminal Carboxyfluorescein
  MOD_RES (20)..(20): C-terminal amidation
AFQSKKNVFVFGYFERLRAK

SEQ ID NO: 190 - protein, 20 aa, Artificial Sequence
  Synthetic peptide
  MOD_RES (1)..(1): N-terminal acetylation
  MOD_RES (20)..(20): C-terminal amidation
FQSKGNVFVFGYFERLRAKL

SEQ ID NO: 191 - protein, 20 aa, Artificial Sequence
  Synthetic peptide
  MOD_RES (1)..(1): N-terminal acetylation
  MOD_RES (20)..(20): C-terminal amidation
FQSKKNVFVVGYFERLRAKL

SEQ ID NO: 192 - protein, 20 aa, Artificial Sequence
  Synthetic peptide
  MOD_RES (1)..(1): N-terminal acetylation
  MOD_RES (20)..(20): C-terminal amidation
FQSKKNVHVFGYFERLRAKL

SEQ ID NO: 193 - protein, 20 aa, Artificial Sequence
  Synthetic peptide
  MOD_RES (1)..(1): N-terminal acetylation
  MOD_RES (20)..(20): C-terminal amidation
FQSKKNVFVKGYFERLRAKL

SEQ ID NO: 194 - protein, 20 aa, Artificial Sequence
  Synthetic peptide
  MOD_RES (1)..(1): N-terminal acetylation
  MOD_RES (20)..(20): C-terminal amidation
FQSKKNVFVPGYFERLRAKL

SEQ ID NO: 195 - protein, 20 aa, Artificial Sequence
  Synthetic peptide
  MOD_RES (1)..(1): N-terminal acetylation
  MOD_RES (20)..(20): C-terminal amidation
FQSKKNVFVRGYFERLRAKL

SEQ ID NO: 196 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEELRAKL

SEQ ID NO: 197 - protein, 20 aa, Artificial Sequence
  Synthetic peptide
  MOD_RES (1)..(1): N-terminal acetylation
  MOD_RES (20)..(20): C-terminal amidation
FQSKQNVFVNGYFERLRAKL

SEQ ID NO: 198 - protein, 20 aa, Artificial Sequence
  Synthetic peptide
  MOD_RES (1)..(1): N-terminal acetylation
  MOD_RES (20)..(20): C-terminal amidation
FQSKQNVFVHGYFERLRAKL

SEQ ID NO: 199 - protein, 20 aa, Artificial Sequence
  Synthetic peptide
  MOD_RES (1)..(1): N-terminal acetylation
  MOD_RES (20)..(20): C-terminal amidation
FQSKQNVFVKGYFERLRAKL

SEQ ID NO: 200 - protein, 20 aa, Artificial Sequence
  Synthetic peptide
  MOD_RES (1)..(1): N-terminal acetylation
  MOD_RES (20)..(20): C-terminal amidation
FQSKQNVFVEGYFERLRAKL

SEQ ID NO: 201 - protein, 20 aa, Artificial Sequence
  Synthetic peptide
  MOD_RES (1)..(1): N-terminal acetylation
  MOD_RES (1)..(1): (S)-N-methyl-phenylalanine
  MOD_RES (20)..(20): C-terminal amidation
AQSKGNVFVFGYFERLRAKL

SEQ ID NO: 202 - protein, 20 aa, Artificial Sequence
  Synthetic peptide
  MOD_RES (1)..(1): N-terminal acetylation
  MOD_RES (4)..(4): (S)-N-methyl-lysine
  MOD_RES (20)..(20): C-terminal amidation
FQSKGNVFVFGYFERLRAKL

SEQ ID NO: 203 - protein, 20 aa, Artificial Sequence
  Synthetic peptide
  MOD_RES (1)..(1): N-terminal acetylation
  MOD_RES (17)..(17): beta-Homoarginine
  MOD_RES (20)..(20): C-terminal amidation
FQSKGNVFVFGYFERLRAKL

SEQ ID NO: 204 - protein, 20 aa, Artificial Sequence
  Synthetic peptide
  MOD_RES (1)..(1): N-terminal acetylation
  MOD_RES (20)..(20): beta-Homoleucine
  MOD_RES (20)..(20): C-terminal amidation
FQSKGNVFVFGYFERLRAKL

SEQ ID NO: 205 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFKRLRAKL

SEQ ID NO: 206 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVFGYFARLRAKL

SEQ ID NO: 207 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKNVFVFGYFERLRAKL

SEQ ID NO: 208 - protein, 20 aa, Artificial Sequence
  Synthetic peptide
  MOD_RES (1)..(1): N-terminal acetylation
  MOD_RES (20)..(20): C-terminal amidation
FQSKGNVFVNGYFDRLRAKL

SEQ ID NO: 209 - protein, 20 aa, Artificial Sequence
  Synthetic peptide
  MOD_RES (1)..(1): N-terminal acetylation
  MOD_RES (20)..(20): C-terminal amidation
FQSKGNVFVKGYFDRLRAKL

SEQ ID NO: 210 - protein, 20 aa, Artificial Sequence
  Synthetic peptide
  MOD_RES (1)..(1): N-terminal acetylation
  MOD_RES (20)..(20): C-terminal amidation
FQSKGNVFVEGYFDRLRAKL

SEQ ID NO: 211 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFKRLRAKL

SEQ ID NO: 212 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLAAKL

SEQ ID NO: 213 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is Norleucine
  MOD_RES (20)..(20): C-terminal amidation
FQSKGNVFVTGYFERLXAKL

SEQ ID NO: 214 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVTGYFARLRAKL

SEQ ID NO: 215 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVDGYFARLRAKL

SEQ ID NO: 216 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLIAKL

SEQ ID NO: 217 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVFGYFARLRAKL

SEQ ID NO: 218 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is Norleucine
  MOD_RES (20)..(20): C-terminal amidation
FQSKGAVFVAGYFARLXAKL

SEQ ID NO: 219 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLVAKL

SEQ ID NO: 220 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFWRLRAKL

SEQ ID NO: 221 - protein, 20 aa, Artificial Sequence
  Synthetic peptide
  MOD_RES (1)..(1): N-terminal acetylation
  MOD_RES (20)..(20): C-terminal amidation
FQSKDAVFVDGYFARLRAKL

SEQ ID NO: 222 - protein, 20 aa, Artificial Sequence
  Synthetic peptide
  MOD_RES (1)..(1): N-terminal acetylation
  MOD_RES (20)..(20): C-terminal amidation
FQSKGAVFVAGYFARLRAKL

SEQ ID NO: 223 - protein, 20 aa, Artificial Sequence
  Synthetic peptide
  MOD_RES (1)..(1): N-terminal acetylation
  MOD_RES (20)..(20): C-terminal amidation
FQSKDAVFVAGYFARLRAKL

SEQ ID NO: 224 - protein, 20 aa, Artificial Sequence
  Synthetic peptide
  MOD_RES (1)..(1): N-terminal acetylation
  MOD_RES (20)..(20): C-terminal amidation
FQSKGAVFVKGYFARLRAKL

SEQ ID NO: 225 - protein, 20 aa, Artificial Sequence
  Synthetic peptide
  MOD_RES (1)..(1): N-terminal acetylation
  MOD_RES (20)..(20): C-terminal amidation
FQSKDAVFVKGYFARLRAKL

SEQ ID NO: 226 - protein, 20 aa, Artificial Sequence
  Synthetic peptide
  MOD_RES (1)..(1): N-terminal acetylation
  MOD_RES (20)..(20): C-terminal amidation
FQSKGAVFVTGYFARLRAKL

SEQ ID NO: 227 - protein, 20 aa, Artificial Sequence
  Synthetic peptide
  MOD_RES (1)..(1): N-terminal acetylation
  MOD_RES (20)..(20): C-terminal amidation
FQSKDAVFVTGYFARLRAKL

SEQ ID NO: 228 - protein, 20 aa, Artificial Sequence
  Synthetic peptide
  MOD_RES (1)..(1): N-terminal acetylation
  MOD_RES (20)..(20): C-terminal N-methyl
FQSKGNVFVFGYFERLRAKL

SEQ ID NO: 229 - protein, 20 aa, Artificial Sequence
  Synthetic peptide
  MOD_RES (1)..(1): N-terminal acetylation
  MOD_RES (20)..(20): C-terminal amidation
FQSKFNVFVDGYFERLRAKL

SEQ ID NO: 230 - protein, 20 aa, Artificial Sequence
  Synthetic peptide
  MOD_RES (1)..(1): N-terminal acetylation
  MOD_RES (20)..(20): C-terminal amidation
FQSKGNVFVAGYFERLRAKL

SEQ ID NO: 231 - protein, 20 aa, Artificial Sequence
  Synthetic peptide
  MOD_RES (1)..(1): N-terminal acetylation
  MOD_RES (20)..(20): C-terminal amidation
FQSKGNVFVMGYFERLRAKL

SEQ ID NO: 232 - protein, 20 aa, Artificial Sequence
  Synthetic peptide
  MOD_RES (1)..(1): N-terminal acetylation
  MOD_RES (20)..(20): C-terminal amidation
FQSKGNVFVPGYFERLRAKL

SEQ ID NO: 233 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFMRLAAKL

SEQ ID NO: 234 - protein, 20 aa, Artificial Sequence
  Synthetic peptide
  MOD_RES (1)..(1): N-terminal acetylation
  MOD_RES (20)..(20): C-terminal amidation
YQSKNNVFVDGYFERLAAKL

SEQ ID NO: 235 - protein, 20 aa, Artificial Sequence
  Synthetic peptide
  MOD_RES (1)..(1): N-terminal acetylation
  MOD_RES (20)..(20): C-terminal amidation
FQSKGHVFVDGYFERLAAKL

SEQ ID NO: 236 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLAAKL

SEQ ID NO: 237 - protein, 20 aa, Artificial Sequence
  Synthetic peptide
  MOD_RES (1)..(1): N-terminal acetylation
  MOD_RES (20)..(20): C-terminal amidation
FQTKHNVFVDGYFERLAAKL

SEQ ID NO: 238 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLAAKL

SEQ ID NO: 239 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFERLAAKL

SEQ ID NO: 240 - protein, 20 aa, Artificial Sequence
  Synthetic peptide
  MOD_RES (1)..(1): N-terminal acetylation
  MOD_RES (20)..(20): C-terminal amidation
FQSKDHVFVDGYFERLAAKL

SEQ ID NO: 241 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLARKL

SEQ ID NO: 242 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLAAKL

SEQ ID NO: 243 - protein, 20 aa, Artificial Sequence
  Synthetic peptide
  MOD_RES (1)..(1): N-terminal acetylation
  MOD_RES (20)..(20): C-terminal amidation
FQSKLNVFVDGYFERLAAKL

SEQ ID NO: 244 - protein, 20 aa, Artificial Sequence
  Synthetic peptide
  MOD_RES (1)..(1): N-terminal acetylation
  MOD_RES (20)..(20): C-terminal amidation
FQSVGNVFVDGYFERLSAKL

SEQ ID NO: 245 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLRAKL

SEQ ID NO: 246 - protein, 20 aa, Artificial Sequence
  Synthetic peptide
  MOD_RES (1)..(1): N-terminal acetylation
  MOD_RES (20)..(20): C-terminal amidation
FQSGGNVFVDGYFERLCAKL

SEQ ID NO: 247 - protein, 20 aa, Artificial Sequence
  Synthetic peptide
  MOD_RES (1)..(1): N-terminal acetylation
  MOD_RES (13)..(13): Xaa is 2-Amino-isobutyric acid
  MOD_RES (17)..(17): Xaa is 2-Amino-isobutyric acid
  MOD_RES (20)..(20): C-terminal amidation
FQSKGNVFVDGYXERLXAKL

SEQ ID NO: 248 - protein, 20 aa, Artificial Sequence
  Synthetic peptide
  MOD_RES (1)..(1): N-terminal acetylation
  MOD_RES (14)..(14): Xaa is 2-Amino-isobutyric acid
  MOD_RES (17)..(17): Xaa is 2-Amino-isobutyric acid
  MOD_RES (20)..(20): C-terminal amidation
FQSKGNVFVDGYFXRLXAKL

SEQ ID NO: 249 - protein, 20 aa, Artificial Sequence
  Synthetic peptide
  MOD_RES (1)..(1): N-terminal acetylation
  MOD_RES (20)..(20): C-terminal amidation
FQSYKHVFVDGYFERLRAKL

SEQ ID NO: 250 - protein, 20 aa, Artificial Sequence
  Synthetic peptide
  MOD_RES (1)..(1): N-terminal acetylation
  MOD_RES (20)..(20): C-terminal amidation
FQSKGIVFVDGYFKRLRAKL

SEQ ID NO: 251 - protein, 20 aa, Artificial Sequence
  Synthetic peptide
  MOD_RES (1)..(1): N-terminal acetylation
  MOD_RES (20)..(20): C-terminal amidation
FQSYKRVFVDGYFERLRAKL

SEQ ID NO: 252 - protein, 21 aa, Artificial Sequence
  Synthetic peptide
  MOD_RES (1)..(1): N-terminal acetylation
  MOD_RES (17)..(17): Xaa is 2-Amino-isobutyric acid
  MOD_RES (21)..(21): PEGYLATION
  MOD_RES (21)..(21): C-terminal amidation
FQSKGNVFVDGYFERLXAKLC

SEQ ID NO: 253 - protein, 31 aa, Artificial Sequence
  Synthetic peptide
  MOD_RES (1)..(1): N-terminal acetylation
  MOD_RES (31)..(31): C-terminal amidation
SGVGRLQVAFQSKKNVFVFGYFERLRAKLTS

SEQ ID NO: 254 - protein, 24 aa, Artificial Sequence
  Synthetic peptide
  MOD_RES (1)..(1): N-terminal acetylation
  MOD_RES (24)..(24): C-terminal amidation
KKAFQSKKNVFVFGYFERLRAKKK

SEQ ID NO: 255 - protein, 24 aa, Artificial Sequence
  Synthetic peptide
  MOD_RES (1)..(1): N-terminal acetylation
  MOD_RES (24)..(24): C-terminal amidation
KKQSKKNVFVFGYFERLRAKLTKK

SEQ ID NO: 256 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKL

SEQ ID NO: 257 - protein, 20 aa, Artificial Sequence
  Synthetic peptide
  MOD_RES (1)..(1): N-terminal acetylation
  MOD_RES (20)..(20): C-terminal amidation
YQSKKNVFVFGYFERLRAKL

SEQ ID NO: 258 - protein, 20 aa, Artificial Sequence
  Synthetic peptide
  MOD_RES (1)..(1): N-terminal acetylation
  MOD_RES (20)..(20): C-terminal amidation
FQSKKNVFVAGYFERLRAKL

SEQ ID NO: 259 - protein, 20 aa, Artificial Sequence
  Synthetic peptide
  MOD_RES (1)..(1): N-terminal acetylation
  MOD_RES (20)..(20): C-terminal amidation
FQSKKNVFVLGYFERLRAKL

SEQ ID NO: 260 - protein, 20 aa, Artificial Sequence
  Synthetic peptide
  MOD_RES (1)..(1): N-terminal acetylation
  MOD_RES (20)..(20): C-terminal amidation
FQSKKNVFVQGYFERLRAKL

SEQ ID NO: 261 - protein, 20 aa, Artificial Sequence
  Synthetic peptide
  MOD_RES (1)..(1): N-terminal acetylation
  MOD_RES (20)..(20): C-terminal amidation
FQSKKNVFVYGYFERLRAKL

SEQ ID NO: 262 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFDRLRAKL

SEQ ID NO: 263 - protein, 20 aa, Artificial Sequence
  Synthetic peptide
  MOD_RES (1)..(1): N-terminal acetylation
FQSKNNVFVAGYFDRLRAKL

SEQ ID NO: 264 - protein, 20 aa, Artificial Sequence
  Synthetic peptide
  MOD_RES (1)..(1): N-terminal acetylation
  MOD_RES (20)..(20): C-terminal amidation
FQSKKNQFVFGYFERLRAKL

SEQ ID NO: 265 - protein, 20 aa, Artificial Sequence
  Synthetic peptide
  MOD_RES (1)..(1): N-terminal acetylation
  MOD_RES (20)..(20): C-terminal amidation
FQSPKNVFVFGYFERLRAKL

SEQ ID NO: 266 - protein, 20 aa, Artificial Sequence
  Synthetic peptide
  MOD_RES (1)..(1): N-terminal acetylation
  MOD_RES (20)..(20): C-terminal amidation
FQSKKNVFVGGYFERLRAKL

SEQ ID NO: 267 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFLRLRAKL

SEQ ID NO: 268 - protein, 21 aa, Artificial Sequence
  Synthetic peptide
  MOD_RES (1)..(1): N-terminal acetylation
  MOD_RES (1)..(1): Xaa is 13-Amino-4,7,10-trioxa-tridecayl)-succinamic acid
  MOD_RES (20)..(20): C-terminal amidation
XFQSKKNVFVFGYFERLRAKL

SEQ ID NO: 269 - protein, 20 aa, Artificial Sequence
  Synthetic peptide
  MOD_RES (1)..(1): N-terminal acetylation
  MOD_RES (11)..(11): N-methyl-Gly
  MOD_RES (20)..(20): C-terminal amidation
FQSKGNVFVFGYFERLRAKL

SEQ ID NO: 270 - protein, 20 aa, Artificial Sequence
  Synthetic peptide
  MOD_RES (1)..(1): N-terminal acetylation
  MOD_RES (5)..(5): beta-Ala
  MOD_RES (20)..(20): C-terminal amidation
FQSKANVFVFGYFERLRAKL

SEQ ID NO: 271 - protein, 20 aa, Artificial Sequence
  Synthetic peptide
  MOD_RES (1)..(1): N-terminal acetylation
  MOD_RES (6)..(6): beta-Homoasparagin
  MOD_RES (20)..(20): C-terminal amidation
FQSKGDVFVFGYFERLRAKL

SEQ ID NO: 272 - protein, 20 aa, Artificial Sequence
  Synthetic peptide
  MOD_RES (1)..(1): N-terminal acetylation
  MOD_RES (14)..(14): beta-Homoaspartic acid
  MOD_RES (20)..(20): C-terminal amidation
FQSKGNVFVFGYFDRLRAKL

SEQ ID NO: 273 - protein, 20 aa, Artificial Sequence
  Synthetic peptide
  MOD_RES (1)..(1): N-terminal acetylation
  MOD_RES (17)..(17): Xaa is (S)-Citrullin
  MOD_RES (20)..(20): C-terminal amidation
FQSKGNVFVFGYFERLXAKL

SEQ ID NO: 274 - protein, 20 aa, Artificial Sequence
  Synthetic peptide
  MOD_RES (1)..(1): N-terminal acetylation
  MOD_RES (20)..(20): C-terminal amidation
FQSGKNVFVFGYFERLRAKL

SEQ ID NO: 275 - protein, 20 aa, Artificial Sequence
  Synthetic peptide
  MOD_RES (1)..(1): N-terminal acetylation
  MOD_RES (20)..(20): C-terminal amidation
FQSKKGVFVFGYFERLRAKL

SEQ ID NO: 276 - protein, 20 aa, Artificial Sequence
  Synthetic peptide
  MOD_RES (1)..(1): N-terminal acetylation
  MOD_RES (20)..(20): C-terminal amidation
FQKKKNVFVFGYFERLRAKL

SEQ ID NO: 277 - protein, 20 aa, Artificial Sequence
  Synthetic peptide
  MOD_RES (1)..(1): N-terminal acetylation
  MOD_RES (20)..(20): C-terminal amidation
FQSKKKVFVFGYFERLRAKL

SEQ ID NO: 278 - protein, 20 aa, Artificial Sequence
  Synthetic peptide
  MOD_RES (1)..(1): N-terminal acetylation
  MOD_RES (20)..(20): C-terminal amidation
FQSKKNKFVFGYFERLRAKL

SEQ ID NO: 279 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLKAKL

SEQ ID NO: 280 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRKKL

SEQ ID NO: 281 - protein, 20 aa, Artificial Sequence
  Synthetic peptide
  MOD_RES (1)..(1): N-terminal acetylation
  MOD_RES (20)..(20): C-terminal amidation
FQDKKNVFVFGYFERLRAKL

SEQ ID NO: 282 - protein, 20 aa, Artificial Sequence
  Synthetic peptide
  MOD_RES (1)..(1): N-terminal acetylation
  MOD_RES (20)..(20): C-terminal amidation
FQSKKDVFVFGYFERLRAKL

SEQ ID NO: 283 - protein, 20 aa, Artificial Sequence
  Synthetic peptide
  MOD_RES (1)..(1): N-terminal acetylation
FQSKGNVFVFGYFERLRAKL

SEQ ID NO: 284 - protein, 20 aa, Artificial Sequence
  Synthetic peptide
  MOD_RES (20)..(20): C-terminal amidation
FQSKGNVFVFGYFERLRAKL

SEQ ID NO: 285 - protein, 22 aa, Artificial Sequence
  Synthetic peptide
GSFQSKKNVFVDGYFERLRAKL

SEQ ID NO: 286 - protein, 20 aa, Artificial Sequence
  Synthetic peptide
  MOD_RES (1)..(1): N-terminal acetylation
  MOD_RES (20)..(20): C-terminal amidation
FQSKGNLFVFGYFERLRAKL

SEQ ID NO: 287 - protein, 20 aa, Artificial Sequence
  Synthetic peptide
  MOD_RES (1)..(1): N-terminal acetylation
  MOD_RES (20)..(20): C-terminal amidation
FQSKGNVFIFGYFERLRAKL

SEQ ID NO: 288 - protein, 20 aa, Artificial Sequence
  Synthetic peptide
  MOD_RES (1)..(1): N-terminal acetylation
  MOD_RES (20)..(20): C-terminal amidation
FQSKKAVFVFGYFERLRAKL

SEQ ID NO: 289 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFARLRAKL

SEQ ID NO: 290 - protein, 20 aa, Artificial Sequence
  Synthetic peptide
  MOD_RES (1)..(1): N-terminal acetylation
  MOD_RES (4)..(4): D-Lys
  MOD_RES (20)..(20): C-terminal amidation
FQSKKNVFVFGYFERLRAKL

SEQ ID NO: 291 - protein, 20 aa, Artificial Sequence
  Synthetic peptide
  MOD_RES (1)..(1): N-terminal acetylation
  MOD_RES (9)..(9): D-Phe
  MOD_RES (20)..(20): C-terminal amidation
FQSKKNVFFFGYFERLRAKL

SEQ ID NO: 292 - protein, 20 aa, Artificial Sequence
  Synthetic peptide
  MOD_RES (1)..(1): N-terminal acetylation
  MOD_RES (20)..(20): C-terminal amidation
FQSKGNVFVHGYFDRLRAKL

SEQ ID NO: 293 - protein, 20 aa, Artificial Sequence
  Synthetic peptide
  MOD_RES (1)..(1): N-terminal acetylation
  MOD_RES (17)..(17): omega-methyl-Arg
  MOD_RES (20)..(20): C-terminal amidation
FQSKKNVFVFGYFERLRAKL

SEQ ID NO: 294 - protein, 20 aa, Artificial Sequence
  Synthetic peptide
  MOD_RES (1)..(1): N-terminal acetylation
  MOD_RES (20)..(20): C-terminal amidation
FQAKGNVFVDGYFERLRAKL

SEQ ID NO: 295 - protein, 20 aa, Artificial Sequence
  Synthetic peptide
  MOD_RES (1)..(1): N-terminal acetylation
  MOD_RES (20)..(20): C-terminal amidation
FQSAGNVFVDGYFERLRAKL

SEQ ID NO: 296 - protein, 20 aa, Artificial Sequence
  Synthetic peptide
  MOD_RES (1)..(1): N-terminal acetylation
  MOD_RES (20)..(20): C-terminal amidation
FQSDGNVFVDGYFERLRAKL

SEQ ID NO: 297 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRDKL

SEQ ID NO: 298 - protein, 20 aa, Artificial Sequence
  Synthetic peptide
  MOD_RES (1)..(1): N-terminal acetylation
  MOD_RES (20)..(20): C-terminal amidation
FQEKGNVFVDGYFERLRAKL

SEQ ID NO: 299 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLREKL

SEQ ID NO: 300 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVDGYFERLRAKL

SEQ ID NO: 301 - protein, 20 aa, Artificial Sequence
  Synthetic peptide
  MOD_RES (1)..(1): N-terminal acetylation
  MOD_RES (20)..(20): C-terminal amidation
FQSFGNVFVDGYFERLRAKL

SEQ ID NO: 302 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVAGYFARLRAKL

SEQ ID NO: 303 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLFAKL

SEQ ID NO: 304 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRFKL

SEQ ID NO: 305 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLRAKL

SEQ ID NO: 306 - protein, 20 aa, Artificial Sequence
  Synthetic peptide
  MOD_RES (1)..(1): N-terminal acetylation
  MOD_RES (20)..(20): C-terminal amidation
FQHKGNVFVDGYFERLRAKL

SEQ ID NO: 307 - protein, 20 aa, Artificial Sequence
  Synthetic peptide
  MOD_RES (1)..(1): N-terminal acetylation
  MOD_RES (20)..(20): C-terminal amidation
FQSHGNVFVDGYFERLRAKL

SEQ ID NO: 308 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFHRLRAKL

SEQ ID NO: 309 - protein, 20 aa, Artificial Sequence
  Synthetic peptide
  MOD_RES (1)..(1): N-terminal acetylation
  MOD_RES (20)..(20): C-terminal amidation
IQSKGNVFVDGYFERLRAKL

SEQ ID NO: 310 - protein, 20 aa, Artificial Sequence
  Synthetic peptide
  MOD_RES (1)..(1): N-terminal acetylation
  MOD_RES (20)..(20): C-terminal amidation
FQIKGNVFVDGYFERLRAKL

SEQ ID NO: 311 - protein, 20 aa, Artificial Sequence
  Synthetic peptide
  MOD_RES (1)..(1): N-terminal acetylation
  MOD_RES (20)..(20): C-terminal amidation
FQSKGIVFVDGYFERLRAKL

SEQ ID NO: 312 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFIRLRAKL

SEQ ID NO: 313 - protein, 20 aa, Artificial Sequence
  Synthetic peptide
  MOD_RES (1)..(1): N-terminal acetylation
  MOD_RES (20)..(20): C-terminal amidation
FQSKGLVFVDGYFERLRAKL

SEQ ID NO: 314 - protein, 20 aa, Artificial Sequence
  Synthetic peptide
  MOD_RES (1)..(1): N-terminal acetylation
  MOD_RES (20)..(20): C-terminal amidation
FQSKGNVFVDGYLERLRAKL

SEQ ID NO: 315 - protein, 20 aa, Artificial Sequence
  Synthetic peptide
  MOD_RES (1)..(1): N-terminal acetylation
  MOD_RES (20)..(20): C-terminal amidation
FQNKGNVFVDGYFERLRAKL

SEQ ID NO: 316 - protein, 20 aa, Artificial Sequence
  Synthetic peptide
  MOD_RES (1)..(1): N-terminal acetylation
  MOD_RES (20)..(20): C-terminal amidation
FQSNGNVFVDGYFERLRAKL

SEQ ID NO: 317 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLNAKL

SEQ ID NO: 318 - protein, 20 aa, Artificial Sequence
  Synthetic peptide
  MOD_RES (1)..(1): N-terminal acetylation
  MOD_RES (20)..(20): C-terminal amidation
FQSQGNVFVDGYFERLRAKL

SEQ ID NO: 319 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRQKL

SEQ ID NO: 320 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRARL

SEQ ID NO: 321 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKR

SEQ ID NO: 322 - protein, 20 aa, Artificial Sequence
  Synthetic peptide
FQSKGNVFVDGYFSRLRAKL

SEQ ID NO: 323 - protein, 20 aa, Artificial Sequence
  Synthetic peptide
FQSKGNVFVDGYFERLTAKL

SEQ ID NO: 324 - protein, 20 aa, Artificial Sequence
  Synthetic peptide
VQSKGNVFVDGYFERLRAKL

SEQ ID NO: 325 - protein, 20 aa, Artificial Sequence
  Synthetic peptide
  MOD_RES (1)..(1): N-terminal acetylation
  MOD_RES (20)..(20): C-terminal amidation
FQVKGNVFVDGYFERLRAKL

SEQ ID NO: 326 - protein, 20 aa, Artificial Sequence
  Synthetic peptide
  MOD_RES (1)..(1): N-terminal acetylation
  MOD_RES (20)..(20): C-terminal amidation
FQSVGNVFVDGYFERLRAKL

SEQ ID NO: 327 - protein, 20 aa, Artificial Sequence
  Synthetic peptide
  MOD_RES (1)..(1): N-terminal acetylation
  MOD_RES (20)..(20): C-terminal amidation
FQSKGVVFVDGYFERLRAKL

SEQ ID NO: 328 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRVKL

SEQ ID NO: 329 - protein, 20 aa, Artificial Sequence
  Synthetic peptide
  MOD_RES (1)..(1): N-terminal acetylation
  MOD_RES (20)..(20): C-terminal amidation
WQSKGNVFVDGYFERLRAKL

SEQ ID NO: 330 - protein, 20 aa, Artificial Sequence
  Synthetic peptide
  MOD_RES (1)..(1): N-terminal acetylation
  MOD_RES (20)..(20): C-terminal amidation
FQSKGNVFVDGYWERLRAKL

SEQ ID NO: 331 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRWKL

SEQ ID NO: 332 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKW

SEQ ID NO: 333 - protein, 20 aa, Artificial Sequence
  Synthetic peptide
  MOD_RES (1)..(1): N-terminal acetylation
  MOD_RES (20)..(20): C-terminal amidation
FQSKGYVFVDGYFERLRAKL

SEQ ID NO: 334 - protein, 20 aa, Artificial Sequence
  Synthetic peptide
  MOD_RES (1)..(1): N-terminal acetylation
  MOD_RES (20)..(20): C-terminal amidation
FQSKGNYFVDGYFERLRAKL

SEQ ID NO: 335 - protein, 20 aa, Artificial Sequence
  Synthetic peptide
  MOD_RES (1)..(1): N-terminal acetylation
  MOD_RES (20)..(20): C-terminal amidation
FQSKGNVFVDGYYERLRAKL

SEQ ID NO: 336 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFYRLRAKL

SEQ ID NO: 337 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLYAKL

SEQ ID NO: 338 - protein, 20 aa, Artificial Sequence
  Synthetic peptide
  MOD_RES (1)..(1): N-terminal acetylation
  MOD_RES (5)..(5): Xaa is 2-Amino-isobutyric acid
  MOD_RES (20)..(20): C-terminal amidation
FQSKXNVFVFGYFERLRAKL

SEQ ID NO: 339 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLRAKL

SEQ ID NO: 340 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLRAKL

SEQ ID NO: 341 - protein, 20 aa, Artificial Sequence
  Synthetic peptide
  MOD_RES (1)..(1): N-terminal acetylation
  MOD_RES (20)..(20): C-terminal amidation
FQSKLNVFVDGYFERLRAKL

SEQ ID NO: 342 - protein, 20 aa, Artificial Sequence
  Synthetic peptide
  MOD_RES (1)..(1): N-terminal acetylation
  MOD_RES (20)..(20): C-terminal amidation
FQSKRNVFVDGYFERLRAKL

SEQ ID NO: 343 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLRAKL

SEQ ID NO: 344 - protein, 20 aa, Artificial Sequence
  Synthetic peptide
  MOD_RES (1)..(1): N-terminal acetylation
  MOD_RES (20)..(20): C-terminal amidation
FQSKGNVFVGGYFERLRAKL

SEQ ID NO: 345 - protein, 20 aa, Artificial Sequence
  Synthetic peptide
  MOD_RES (1)..(1): N-terminal acetylation
  MOD_RES (20)..(20): C-terminal amidation
FQSKGNVFVWGYFERLRAKL

SEQ ID NO: 346 - protein, 20 aa, Artificial Sequence
  Synthetic peptide
  MOD_RES (1)..(1): N-terminal acetylation
  MOD_RES (20)..(20): C-terminal amidation
FQSKGNVFVYGYFERLRAKL

SEQ ID NO: 347 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLAAKL

SEQ ID NO: 348 - protein, 20 aa, Artificial Sequence
  Synthetic peptide
  MOD_RES (1)..(1): N-terminal acetylation
  MOD_RES (20)..(20): C-terminal amidation
FQSRENVFVDGYFERLAAKL

SEQ ID NO: 349 - protein, 20 aa, Artificial Sequence
  Synthetic peptide
  MOD_RES (1)..(1): N-terminal acetylation
  MOD_RES (20)..(20): C-terminal amidation
FQSKDNVFVHGYFERLAAKL

SEQ ID NO: 350 - protein, 20 aa, Artificial Sequence
  Synthetic peptide
  MOD_RES (1)..(1): N-terminal acetylation
  MOD_RES (20)..(20): C-terminal amidation
FQSKERVFVDGYFERLAAKL

SEQ ID NO: 351 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLAIKL

SEQ ID NO: 352 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLAVKL

SEQ ID NO: 353 - protein, 20 aa, Artificial Sequence
  Synthetic peptide
  MOD_RES (1)..(1): N-terminal acetylation
  MOD_RES (20)..(20): C-terminal amidation
FQSRNNVFVDGYFERLAAKL

SEQ ID NO: 354 - protein, 20 aa, Artificial Sequence
  Synthetic peptide
  MOD_RES (1)..(1): N-terminal acetylation
  MOD_RES (20)..(20): C-terminal amidation
FQSRQNVFVDGYFERLAAKL

SEQ ID NO: 355 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLAAKL

SEQ ID NO: 356 - protein, 20 aa, Artificial Sequence
  Synthetic peptide
  MOD_RES (1)..(1): N-terminal acetylation
  MOD_RES (20)..(20): C-terminal amidation
FQSSKNVFVDGYFERLAAKL

SEQ ID NO: 357 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLAAKL

SEQ ID NO: 358 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLAAKL

SEQ ID NO: 359 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLAARL

SEQ ID NO: 360 - protein, 20 aa, Artificial Sequence
  Synthetic peptide
  MOD_RES (1)..(1): N-terminal acetylation
  MOD_RES (20)..(20): C-terminal amidation
FQSKHNVYVDGYFERLAAKL

SEQ ID NO: 361 - protein, 20 aa, Artificial Sequence
  Synthetic peptide
  MOD_RES (1)..(1): N-terminal acetylation
  MOD_RES (20)..(20): C-terminal amidation
FQSKYNIFVDGYFERLAAKL

SEQ ID NO: 362 - protein, 20 aa, Artificial Sequence
  Synthetic peptide
  MOD_RES (1)..(1): N-terminal acetylation
  MOD_RES (20)..(20): C-terminal amidation
FQSKNDVFVDGYFERLAAKL

SEQ ID NO: 363 - protein, 20 aa, Artificial Sequence
  Synthetic peptide
  MOD_RES (1)..(1): N-terminal acetylation
  MOD_RES (20)..(20): C-terminal amidation
FQSGGNVFVDGYFERLAAKL

SEQ ID NO: 364 - protein, 20 aa, Artificial Sequence
  Synthetic peptide
  MOD_RES (1)..(1): N-terminal acetylation
  MOD_RES (20)..(20): C-terminal amidation
FQSPKNVFVDGYFERLAAKL

SEQ ID NO: 365 - protein, 20 aa, Artificial Sequence
  Synthetic peptide
  MOD_RES (1)..(1): N-terminal acetylation
  MOD_RES (20)..(20): C-terminal amidation
FQSPKNVFVDGYFERLRAKL

SEQ ID NO: 366 - protein, 20 aa, Artificial Sequence
  Synthetic peptide
  MOD_RES (1)..(1): N-terminal acetylation
  MOD_RES (20)..(20): C-terminal amidation
FQSRKNVFVDGYFERLRAKL

SEQ ID NO: 367 - protein, 20 aa, Artificial Sequence
  Synthetic peptide
  MOD_RES (1)..(1): N-terminal acetylation
  MOD_RES (20)..(20): C-terminal amidation
FQSKKRVFVDGYFERLRAKL

SEQ ID NO: 368 - protein, 20 aa, Artificial Sequence
  Synthetic peptide
  MOD_RES (1)..(1): N-terminal acetylation
  MOD_RES (20)..(20): C-terminal amidation
FQSIKNVFVDGYFERLRAKL

SEQ ID NO: 369 - protein, 20 aa, Artificial Sequence
  Synthetic peptide
  MOD_RES (1)..(1): N-terminal acetylation
  MOD_RES (20)..(20): C-terminal amidation
CQSKGNVFVDGYFERLRAKL

SEQ ID NO: 370 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRCKL

SEQ ID NO: 371 - protein, 20 aa, Artificial Sequence
  Synthetic peptide
  MOD_RES (1)..(1): N-terminal acetylation
  MOD_RES (20)..(20): C-terminal amidation
FQSKFNVFVDGYFERLCAKL

SEQ ID NO: 372 - protein, 20 aa, Artificial Sequence
  Synthetic peptide
  MOD_RES (1)..(1): N-terminal acetylation
  MOD_RES (20)..(20): C-terminal amidation
FQSKYNVFVDGYHERLCAKL

SEQ ID NO: 373 - protein, 20 aa, Artificial Sequence
  Synthetic peptide
  MOD_RES (1)..(1): N-terminal acetylation
  MOD_RES (20)..(20): C-terminal amidation
FQSSHNVFVDGYFERLCAKL

SEQ ID NO: 374 - protein, 20 aa, Artificial Sequence
  Synthetic peptide
  MOD_RES (1)..(1): N-terminal acetylation
  MOD_RES (20)..(20): C-terminal amidation
FQSRENVFVDGYFERLCAKL

SEQ ID NO: 375 - protein, 20 aa, Artificial Sequence
  Synthetic peptide
  MOD_RES (1)..(1): N-terminal acetylation
  MOD_RES (20)..(20): C-terminal amidation
FQSCKNVFVDGYFERLRAKL

SEQ ID NO: 376 - protein, 20 aa, Artificial Sequence
  Synthetic peptide
  MOD_RES (1)..(1): N-terminal acetylation
  MOD_RES (20)..(20): C-terminal amidation
FQDPKNVFVDGYFERLCAKL

SEQ ID NO: 377 - protein, 20 aa, Artificial Sequence
  Synthetic peptide
  MOD_RES (1)..(1): N-terminal acetylation
  MOD_RES (20)..(20): C-terminal amidation
FQSKTNIFVDGYFERLCAKL

SEQ ID NO: 378 - protein, 20 aa, Artificial Sequence
  Synthetic peptide
  MOD_RES (1)..(1): N-terminal acetylation
  MOD_RES (20)..(20): C-terminal amidation
FQSHYNVFVDGYFERLCAKL

SEQ ID NO: 379 - protein, 20 aa, Artificial Sequence
  Synthetic peptide
  MOD_RES (1)..(1): N-terminal acetylation
  MOD_RES (20)..(20): C-terminal amidation
FQSRQNVFVDGYFERLCAKL

SEQ ID NO: 380 - protein, 20 aa, Artificial Sequence
  Synthetic peptide
  MOD_RES (1)..(1): N-terminal acetylation
  MOD_RES (20)..(20): C-terminal amidation
FQSSKNVFVDGYFERLCAKL

SEQ ID NO: 381 - protein, 20 aa, Artificial Sequence
  Synthetic peptide
  MOD_RES (1)..(1): N-terminal acetylation
  MOD_RES (20)..(20): C-terminal amidation
FQSHHNVFVDGYFERLCAKL

SEQ ID NO: 382 - protein, 20 aa, Artificial Sequence
  Synthetic peptide
  MOD_RES (1)..(1): N-terminal acetylation
  MOD_RES (20)..(20): C-terminal amidation
FQTKHNVFVDGYFERLCAKL

SEQ ID NO: 383 - protein, 20 aa, Artificial Sequence
  Synthetic peptide
  MOD_RES (1)..(1): N-terminal acetylation
  MOD_RES (20)..(20): C-terminal amidation
FQSKANVHVDGYFERLCAKL

SEQ ID NO: 384 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLCRKL

SEQ ID NO: 385 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLCAKL

SEQ ID NO: 386 - protein, 20 aa, Artificial Sequence
  Synthetic peptide
  MOD_RES (1)..(1): N-terminal acetylation
  MOD_RES (20)..(20): C-terminal amidation
FQSHKNVFVDGYFERLCAKL

SEQ ID NO: 387 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLCAKF

SEQ ID NO: 388 - protein, 20 aa, Artificial Sequence
  Synthetic peptide
  MOD_RES (1)..(1): N-terminal acetylation
  MOD_RES (20)..(20): C-terminal amidation
FQSKMNVFVDGYFERLCAKL

SEQ ID NO: 389 - protein, 20 aa, Artificial Sequence
  Synthetic peptide
  MOD_RES (1)..(1): N-terminal acetylation
  MOD_RES (20)..(20): C-terminal amidation
FQSAKNVFVDGYFERLCAKL

SEQ ID NO: 390 - protein, 20 aa, Artificial Sequence
  Synthetic peptide
  MOD_RES (1)..(1): N-terminal acetylation
  MOD_RES (20)..(20): C-terminal amidation
FQSKHVVFVDGYFERLCAKL

SEQ ID NO: 391 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLCARL

SEQ ID NO: 392 - protein, 20 aa, Artificial Sequence
  Synthetic peptide
  MOD_RES (1)..(1): N-terminal acetylation
  MOD_RES (20)..(20): C-terminal amidation
FQSKKHVFVDGYFERLCAKL

SEQ ID NO: 393 - protein, 20 aa, Artificial Sequence
  Synthetic peptide
  MOD_RES (1)..(1): N-terminal acetylation
  MOD_RES (20)..(20): C-terminal amidation
FQSNKNVFVDGYFERLCAKL

SEQ ID NO: 394 - protein, 20 aa, Artificial Sequence
  Synthetic peptide
  MOD_RES (1)..(1): N-terminal acetylation
  MOD_RES (20)..(20): C-terminal amidation
FQSEKNVFVDGYFERLCAKL

SEQ ID NO: 395 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLCFKL

SEQ ID NO: 396 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLSAKL

SEQ ID NO: 397 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLSAKL

SEQ ID NO: 398 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLSAKL

SEQ ID NO: 399 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLSAKL

SEQ ID NO: 400 - protein, 20 aa, Artificial Sequence
  Synthetic peptide
  MOD_RES (1)..(1): N-terminal acetylation
  MOD_RES (17)..(17): Xaa is 2-Amino-isobutyric acid
  MOD_RES (20)..(20): Xaa is 2-Amino-isobutyric acid
  MOD_RES (20)..(20): C-terminal amidation
FQSKGNVFVDGYFERLXAKX

SEQ ID NO: 401 - protein, 21 aa, Artificial Sequence
  Synthetic peptide
  MOD_RES (1)..(1): N-terminal acetylation
  DISULFID (10)..(21): Cys residues linked via disulfide bond
  MOD_RES (17)..(17): Xaa is 2-Amino-isobutyric acid
  MOD_RES (21)..(21): C-terminal amidation
FQSKGNVFVCGYFERLXAKLC

SEQ ID NO: 402 - protein, 21 aa, Artificial Sequence
  Synthetic peptide
  MOD_RES (1)..(1): N-terminal acetylation
  DISULFID (1)..(17): Cys residues linked via disulfide bond
  MOD_RES (21)..(21): C-terminal amidation
CFQSKGNVFVDGYFERLCAKL

SEQ ID NO: 403 - protein, 21 aa, Artificial Sequence
  Synthetic peptide
  MOD_RES (1)..(1): N-terminal acetylation
  DISULFID (1)..(11): Cys residues linked via disulfide bond
  MOD_RES (18)..(18): Xaa is 2-Amino-isobutyric acid
  MOD_RES (21)..(21): C-terminal amidation
CFQSKGNVFVCGYFERLXAKL

SEQ ID NO: 404 - protein, 21 aa, Artificial Sequence
  Synthetic peptide
  DISULFID (1)..(7): Cys residues linked via disulfide bond
  MOD_RES (1)..(1): N-terminal acetylation
  MOD_RES (18)..(18): Xaa is 2-Amino-isobutyric acid
  MOD_RES (21)..(21): C-terminal amidation
CFQSKGCVFVEGYFERLXAKL

SEQ ID NO: 405 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLFAKL

SEQ ID NO: 406 - protein, 22 aa, Artificial Sequence
  Synthetic peptide
  MOD_RES (1)..(1): N-terminal acetylation
  MOD_RES (22)..(22): C-terminal amidation
KKQSKKNVFVFGYFERLRAKKK

SEQ ID NO: 407 - protein, 20 aa, Artificial Sequence
  Synthetic peptide
  MOD_RES (1)..(1): N-terminal acetylation
  MOD_RES (20)..(20): C-terminal amidation
FQNKKNVFVFGYFERLRAKL

SEQ ID NO: 408 - protein, 20 aa, Artificial Sequence
  Synthetic peptide
  MOD_RES (1)..(1): N-terminal acetylation
  MOD_RES (20)..(20): C-terminal amidation
FQSKKNVFAFGYFERLRAKL

SEQ ID NO: 409 - protein, 20 aa, Artificial Sequence
  Synthetic peptide
  MOD_RES (1)..(1): N-terminal acetylation
  MOD_RES (20)..(20): C-terminal amidation
FQSKKNVFSFGYFERLRAKL

SEQ ID NO: 410 - protein, 20 aa, Artificial Sequence
  Synthetic peptide
  MOD_RES (1)..(1): N-terminal acetylation
  MOD_RES (20)..(20): C-terminal amidation
FQSKKNVFTFGYFERLRAKL

SEQ ID NO: 411 - protein, 20 aa, Artificial Sequence
  Synthetic peptide
  MOD_RES (1)..(1): N-terminal acetylation
  MOD_RES (20)..(20): C-terminal amidation
FQSKKNVFVFGYKERLRAKL

SEQ ID NO: 412 - protein, 20 aa, Artificial Sequence
  Synthetic peptide
  MOD_RES (1)..(1): N-terminal acetylation
  MOD_RES (20)..(20): C-terminal amidation
FQSKKNVFVFGYYERLRAKL

SEQ ID NO: 413 - protein, 21 aa, Artificial Sequence
  Synthetic peptide
  MOD_RES (1)..(1): N-terminal Carboxyfluorescein
  MOD_RES (1)..(1): Xaa is (13-Amino-4,7,10-trioxa-tridecayl)-succinamic acid
  MOD_RES (21)..(21): C-terminal amidation
XAFQSKKNVFVFGYFERLRAK

SEQ ID NO: 414 - protein, 20 aa, Artificial Sequence
  Synthetic peptide
  MOD_RES (1)..(1): N-terminal acetylation
  MOD_RES (20)..(20): C-terminal amidation
FQSKKNAFVFGYFERLRAKL

SEQ ID NO: 415 - protein, 20 aa, Artificial Sequence
  Synthetic peptide
  MOD_RES (1)..(1): N-terminal acetylation
  MOD_RES (20)..(20): C-terminal amidation
FQSKKNPFVFGYFERLRAKL

SEQ ID NO: 416 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAVL

SEQ ID NO: 417 - protein, 20 aa, Artificial Sequence
  Synthetic peptide
  MOD_RES (1)..(1): N-terminal acetylation
  MOD_RES (7)..(7): (S)-N-methyl-Val
  MOD_RES (20)..(20): C-terminal amidation
FQSKGNVFVFGYFERLRAKL

SEQ ID NO: 418 - protein, 20 aa, Artificial Sequence
  Synthetic peptide
  MOD_RES (1)..(1): N-terminal acetylation
  MOD_RES (10)..(10): (S)-N-methyl-Phe
  MOD_RES (20)..(20): C-terminal amidation
FQSKGNVFVFGYFERLRAKL

SEQ ID NO: 419 - protein, 20 aa, Artificial Sequence
  Synthetic peptide
  MOD_RES (1)..(1): N-terminal acetylation
  MOD_RES (20)..(20): (S)-N-methyl-Leu
  MOD_RES (20)..(20): C-terminal amidation
FQSKGNVFVFGYFERLRAKL

SEQ ID NO: 420 - protein, 20 aa, Artificial Sequence
  Synthetic peptide
  MOD_RES (1)..(1): beta-Homophenylalanine
  MOD_RES (1)..(1): N-terminal acetylation
  MOD_RES (20)..(20): C-terminal amidation
FQSKGNVFVFGYFERLRAKL

SEQ ID NO: 421 - protein, 20 aa, Artificial Sequence
  Synthetic peptide
  MOD_RES (1)..(1): N-terminal acetylation
  MOD_RES (3)..(3): beta-Homoserine
  MOD_RES (20)..(20): C-terminal amidation
FQSKGNVFVFGYFERLRAKL

SEQ ID NO: 422 - protein, 20 aa, Artificial Sequence
  Synthetic peptide
  MOD_RES (1)..(1): N-terminal acetylation
  MOD_RES (4)..(4): beta-Homolysine
  MOD_RES (20)..(20): C-terminal amidation
FQSKGNVFVFGYFERLRAKL

SEQ ID NO: 423 - protein, 21 aa, Artificial Sequence
  Synthetic peptide
  MOD_RES (1)..(1): N-terminal acetylation
  MOD_RES (19)..(19): beta-Ala
  MOD_RES (21)..(21): C-terminal amidation
FQSKGNVFVFGYFERLRAAKL

SEQ ID NO: 424 - protein, 20 aa, Artificial Sequence
  Synthetic peptide
  MOD_RES (1)..(1): N-terminal acetylation
  MOD_RES (19)..(19): beta-Homolysine
  MOD_RES (20)..(20): C-terminal amidation
FQSKGNVFVFGYFERLRAKL

SEQ ID NO: 425 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKGNVFVFGYFERLXAKL

SEQ ID NO: 426 - protein, 20 aa, Artificial Sequence
  Synthetic peptide
  MOD_RES (1)..(1): N-terminal acetylation
  MOD_RES (20)..(20): C-terminal amidation
GQSKKNVFVFGYFERLRAKL

SEQ ID NO: 427 - protein, 20 aa, Artificial Sequence
  Synthetic peptide
  MOD_RES (1)..(1): N-terminal acetylation
  MOD_RES (20)..(20): C-terminal amidation
FGSKKNVFVFGYFERLRAKL

SEQ ID NO: 428 - protein, 20 aa, Artificial Sequence
  Synthetic peptide
  MOD_RES (1)..(1): N-terminal acetylation
  MOD_RES (20)..(20): C-terminal amidation
FQGKKNVFVFGYFERLRAKL

SEQ ID NO: 429 - protein, 20 aa, Artificial Sequence
  Synthetic peptide
  MOD_RES (1)..(1): N-terminal acetylation
  MOD_RES (20)..(20): C-terminal amidation
FQSKKNGFVFGYFERLRAKL

SEQ ID NO: 430 - protein, 20 aa, Artificial Sequence
  Synthetic peptide
  MOD_RES (1)..(1): N-terminal acetylation
  MOD_RES (20)..(20): C-terminal amidation
FQSKKNVFVFGYGERLRAKL

SEQ ID NO: 431 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFGRLRAKL

SEQ ID NO: 432 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRGKL

SEQ ID NO: 433 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKG

SEQ ID NO: 434 - protein, 20 aa, Artificial Sequence
  Synthetic peptide
  MOD_RES (1)..(1): N-terminal acetylation
  MOD_RES (20)..(20): C-terminal amidation
KQSKKNVFVFGYFERLRAKL

SEQ ID NO: 435 - protein, 20 aa, Artificial Sequence
  Synthetic peptide
  MOD_RES (1)..(1): N-terminal acetylation
  MOD_RES (20)..(20): C-terminal amidation
FKSKKNVFVFGYFERLRAKL

SEQ ID NO: 436 - protein, 20 aa, Artificial Sequence
  Synthetic peptide
  MOD_RES (1)..(1): N-terminal acetylation
  MOD_RES (20)..(20): C-terminal amidation
FQSKKNVKVFGYFERLRAKL

SEQ ID NO: 437 - protein, 20 aa, Artificial Sequence
  Synthetic peptide
  MOD_RES (1)..(1): N-terminal acetylation
  MOD_RES (20)..(20): C-terminal amidation
FQSKKNVFKFGYFERLRAKL

SEQ ID NO: 438 - protein, 20 aa, Artificial Sequence
  Synthetic peptide
  MOD_RES (1)..(1): N-terminal acetylation
  MOD_RES (20)..(20): C-terminal amidation
FQSKKNVFVFKYFERLRAKL

SEQ ID NO: 439 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEKLRAKL

SEQ ID NO: 440 - protein, 20 aa, Artificial Sequence
  Synthetic peptide
  MOD_RES (1)..(1): N-terminal acetylation
  MOD_RES (20)..(20): C-terminal amidation
FQSKKNFFVFGYFERLRAKL

SEQ ID NO: 441 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFFRLRAKL

SEQ ID NO: 442 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKF

SEQ ID NO: 443 - protein, 20 aa, Artificial Sequence
  Synthetic peptide
  MOD_RES (1)..(1): N-terminal acetylation
  MOD_RES (20)..(20): C-terminal amidation
DQSKKNVFVFGYFERLRAKL

SEQ ID NO: 444 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEDLRAKL

SEQ ID NO: 445 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRDKL

SEQ ID NO: 446 - protein, 20 aa, Artificial Sequence
  Synthetic peptide
  MOD_RES (1)..(1): N-terminal acetylation
  MOD_RES (20)..(20): C-terminal amidation
FQSKKNLFVFGYFERLRAKL

SEQ ID NO: 447 - protein, 20 aa, Artificial Sequence
  Synthetic peptide
  MOD_RES (1)..(1): N-terminal acetylation
  MOD_RES (20)..(20): C-terminal amidation
FQAKKNVFVFGYFERLRAKL

SEQ ID NO: 448 - protein, 20 aa, Artificial Sequence
  Synthetic peptide
  MOD_RES (1)..(1): N-terminal acetylation
  MOD_RES (20)..(20): C-terminal amidation
FQSAKNVFVFGYFERLRAKL

SEQ ID NO: 449 - protein, 20 aa, Artificial Sequence
  Synthetic peptide
  MOD_RES (1)..(1): N-terminal acetylation
  MOD_RES (20)..(20): C-terminal amidation
FQSKANVFVFGYFERLRAKL

SEQ ID NO: 450 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLAAKL

SEQ ID NO: 451 - protein, 20 aa, Artificial Sequence
  Synthetic peptide
  MOD_RES (1)..(1): N-terminal acetylation
  MOD_RES (20)..(20): C-terminal amidation
FQPKKNVFVFGYFERLRAKL

SEQ ID NO: 452 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFPRLRAKL

SEQ ID NO: 453 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERPRAKL

SEQ ID NO: 454 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKP

SEQ ID NO: 455 - protein, 20 aa, Artificial Sequence
  Synthetic peptide
  MOD_RES (1)..(1): N-terminal acetylation
  MOD_RES (20)..(20): C-terminal amidation
FQSSKNVFVFGYFERLRAKL

SEQ ID NO: 456 - protein, 20 aa, Artificial Sequence
  Synthetic peptide
  MOD_RES (1)..(1): N-terminal acetylation
  MOD_RES (20)..(20): C-terminal amidation
FQSKKSVFVFGYFERLRAKL

SEQ ID NO: 457 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFSRLRAKL

SEQ ID NO: 458 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRSKL

SEQ ID NO: 459 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRASL

SEQ ID NO: 460 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRALL

SEQ ID NO: 461 - protein, 20 aa, Artificial Sequence
  Synthetic peptide
  MOD_RES (1)..(1): N-terminal acetylation
  MOD_RES (10)..(10): D-Phe
  MOD_RES (20)..(20): C-terminal amidation
FQSKKNVFVFGYFERLRAKL

SEQ ID NO: 462 - protein, 20 aa, Artificial Sequence
  Synthetic peptide
  MOD_RES (1)..(1): N-terminal acetylation
  MOD_RES (12)..(12): D-Tyr
  MOD_RES (20)..(20): C-terminal amidation
FQSKKNVFVFGYFERLRAKL

SEQ ID NO: 463 - protein, 20 aa, Artificial Sequence
  Synthetic peptide
  MOD_RES (1)..(1): N-terminal acetylation
  MOD_RES (14)..(14): D-Glu
  MOD_RES (20)..(20): C-terminal amidation
FQSKKNVFVFGYFERLRAKL

SEQ ID NO: 464 - protein, 20 aa, Artificial Sequence
  Synthetic peptide
  MOD_RES (1)..(1): N-terminal acetylation
  MOD_RES (15)..(15): D-Arg
  MOD_RES (20)..(20): C-terminal amidation
FQSKKNVFVFGYFERLRAKL

SEQ ID NO: 465 - protein, 20 aa, Artificial Sequence
  Synthetic peptide
  MOD_RES (1)..(1): N-terminal acetylation
  MOD_RES (17)..(17): D-Arg
  MOD_RES (20)..(20): C-terminal amidation
FQSKKNVFVFGYFERLRAKL

SEQ ID NO: 466 - protein, 20 aa, Artificial Sequence
  Synthetic peptide
  MOD_RES (1)..(1): N-terminal acetylation
  MOD_RES (1)..(1): D-Phe
  MOD_RES (2)..(2): D-Gln
  MOD_RES (3)..(3): D-Ser
  MOD_RES (4)..(4): D-Lys
  MOD_RES (5)..(5): D-Lys
  MOD_RES (6)..(6): D-Asn
  MOD_RES (7)..(7): D-Val
  MOD_RES (8)..(8): D-Phe
  MOD_RES (9)..(9): D-Val
  MOD_RES (10)..(10): D-Phe
  MOD_RES (11)..(11): D-Gly
  MOD_RES (12)..(12): D-Tyr
  MOD_RES (13)..(13): D-Phe
  MOD_RES (14)..(14): D-Glu
  MOD_RES (15)..(15): D-Arg
  MOD_RES (16)..(16): D-Leu
  MOD_RES (17)..(17): D-Arg
  MOD_RES (18)..(18): D-Ala
  MOD_RES (19)..(19): D-Lys
  MOD_RES (20)..(20): D-Leu
  MOD_RES (20)..(20): C-terminal amidation
FQSKKNVFVFGYFERLRAKL

SEQ ID NO: 467 - protein, 20 aa, Artificial Sequence
  Synthetic peptide
  MOD_RES (1)..(1): N-terminal acetylation
  MOD_RES (1)..(1): D-Leu
  MOD_RES (2)..(2): D-Lys
  MOD_RES (3)..(3): D-Ala
  MOD_RES (4)..(4): D-Arg
  MOD_RES (5)..(5): D-Leu
  MOD_RES (6)..(6): D-Arg
  MOD_RES (7)..(7): D-Glu
  MOD_RES (8)..(8): D-Phe
  MOD_RES (9)..(9): D-Tyr
  MOD_RES (10)..(10): D-Gly
  MOD_RES (11)..(11): D-Phe
  MOD_RES (12)..(12): D-Val
  MOD_RES (13)..(13): D-Phe
  MOD_RES (14)..(14): D-Val
  MOD_RES (15)..(15): D-Asn
  MOD_RES (16)..(16): D-Lys
  MOD_RES (17)..(17): D-Lys
  MOD_RES (18)..(18): D-Ser
  MOD_RES (19)..(19): D-Gln
  MOD_RES (20)..(20): D-Phe
  MOD_RES (20)..(20): C-terminal amidation
LKARLREFYGFVFVNKKSQF

SEQ ID NO: 468 - protein, 20 aa, Artificial Sequence
  Synthetic peptide
  MOD_RES (1)..(1): N-terminal acetylation
  MOD_RES (15)..(15): omega-methyl-Arg
  MOD_RES (20)..(20): C-terminal amidation
FQSKKNVFVFGYFERLRAKL

SEQ ID NO: 469 - protein, 20 aa, Artificial Sequence
  Synthetic peptide
  MOD_RES (1)..(1): N-terminal acetylation
  MOD_RES (20)..(20): C-terminal amidation
AQSKGNVFVDGYFERLRAKL

SEQ ID NO: 470 - protein, 20 aa, Artificial Sequence
  Synthetic peptide
  MOD_RES (1)..(1): N-terminal acetylation
  MOD_RES (20)..(20): C-terminal amidation
FASKGNVFVDGYFERLRAKL

SEQ ID NO: 471 - protein, 20 aa, Artificial Sequence
  Synthetic peptide
  MOD_RES (1)..(1): N-terminal acetylation
  MOD_RES (20)..(20): C-terminal amidation
FQSKGNAFVDGYFERLRAKL

SEQ ID NO: 472 - protein, 20 aa, Artificial Sequence
  Synthetic peptide
  MOD_RES (1)..(1): N-terminal acetylation
  MOD_RES (20)..(20): C-terminal amidation
FQSKGNVFVDGYAERLRAKL

SEQ ID NO: 473 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEALRAKL

SEQ ID NO: 474 - protein, 20 aa, Artificial Sequence
  Synthetic peptide
  MOD_RES (1)..(1): N-terminal acetylation
  MOD_RES (20)..(20): C-terminal amidation
FQDKGNVFVDGYFERLRAKL

SEQ ID NO: 475 - protein, 20 aa, Artificial Sequence
  Synthetic peptide
  MOD_RES (1)..(1): N-terminal acetylation
  MOD_RES (20)..(20): C-terminal amidation
FQSKGDVFVDGYFERLRAKL

SEQ ID NO: 476 - protein, 20 aa, Artificial Sequence
  Synthetic peptide
  MOD_RES (1)..(1): N-terminal acetylation
  MOD_RES (20)..(20): C-terminal amidation
FQSKGNVFVDGDFERLRAKL

SEQ ID NO: 477 - protein, 20 aa, Artificial Sequence
  Synthetic peptide
  MOD_RES (1)..(1): N-terminal acetylation
  MOD_RES (20)..(20): C-terminal amidation
FQSKGNVFVDGYDERLRAKL

SEQ ID NO: 478 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLDAKL

SEQ ID NO: 479 - protein, 20 aa, Artificial Sequence
  Synthetic peptide
  MOD_RES (1)..(1): N-terminal acetylation
  MOD_RES (20)..(20): C-terminal amidation
EQSKGNVFVDGYFERLRAKL

SEQ ID NO: 480 - protein, 20 aa, Artificial Sequence
  Synthetic peptide
  MOD_RES (1)..(1): N-terminal acetylation
  MOD_RES (20)..(20): C-terminal amidation
FQSKGEVFVDGYFERLRAKL

SEQ ID NO: 481 - protein, 20 aa, Artificial Sequence
  Synthetic peptide
  MOD_RES (1)..(1): N-terminal acetylation
  MOD_RES (20)..(20): C-terminal amidation
FQSKGNEFVDGYFERLRAKL

SEQ ID NO: 482 - protein, 20 aa, Artificial Sequence
  Synthetic peptide
  MOD_RES (1)..(1): N-terminal acetylation
  MOD_RES (20)..(20): C-terminal amidation
FQSKGNVFVDGYEERLRAKL

SEQ ID NO: 483 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEELRAKL

SEQ ID NO: 484 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLEAKL

SEQ ID NO: 485 - protein, 20 aa, Artificial Sequence
  Synthetic peptide
  MOD_RES (1)..(1): N-terminal acetylation
  MOD_RES (20)..(20): C-terminal amidation
FFSKGNVFVDGYFERLRAKL

SEQ ID NO: 486 - protein, 20 aa, Artificial Sequence
  Synthetic peptide
  MOD_RES (1)..(1): N-terminal acetylation
  MOD_RES (20)..(20): C-terminal amidation
FQFKGNVFVDGYFERLRAKL

SEQ ID NO: 487 - protein, 20 aa, Artificial Sequence
  Synthetic peptide
  MOD_RES (1)..(1): N-terminal acetylation
  MOD_RES (20)..(20): C-terminal amidation
FQSKGFVFVDGYFERLRAKL

SEQ ID NO: 488 - protein, 20 aa, Artificial Sequence
  Synthetic peptide
  MOD_RES (1)..(1): N-terminal acetylation
  MOD_RES (20)..(20): C-terminal amidation
FQSKGNFFVDGYFERLRAKL

SEQ ID NO: 489 - protein, 20 aa, Artificial Sequence
  Synthetic peptide
  MOD_RES (1)..(1): N-terminal acetylation
  MOD_RES (20)..(20): C-terminal amidation
FQSKGNVFFDGYFERLRAKL

SEQ ID NO: 490 - protein, 20 aa, Artificial Sequence
  Synthetic peptide
  MOD_RES (1)..(1): N-terminal acetylation
  MOD_RES (5)..(5): D-Ala
  MOD_RES (17)..(17): Xaa is (S)-Norleucine
  MOD_RES (20)..(20): C-terminal amidation
FQSKAAVFVAGYFARLXAKL

SEQ ID NO: 491 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFFRLRAKL

SEQ ID NO: 492 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEFLRAKL

SEQ ID NO: 493 - protein, 20 aa, Artificial Sequence
  Synthetic peptide
  MOD_RES (1)..(1): N-terminal acetylation
  MOD_RES (20)..(20): C-terminal amidation
FGSKGNVFVDGYFERLRAKL

SEQ ID NO: 494 - protein, 20 aa, Artificial Sequence
  Synthetic peptide
  MOD_RES (1)..(1): N-terminal acetylation
  MOD_RES (20)..(20): C-terminal amidation
FQGKGNVFVDGYFERLRAKL

SEQ ID NO: 495 - protein, 20 aa, Artificial Sequence
  Synthetic peptide
  MOD_RES (1)..(1): N-terminal acetylation
  MOD_RES (20)..(20): C-terminal amidation
FQSGGNVFVDGYFERLRAKL

SEQ ID NO: 496 - protein, 20 aa, Artificial Sequence
  Synthetic peptide
  MOD_RES (1)..(1): N-terminal acetylation
  MOD_RES (20)..(20): C-terminal amidation
FQSKGGVFVDGYFERLRAKL

SEQ ID NO: 497 - protein, 20 aa, Artificial Sequence
  Synthetic peptide
  MOD_RES (1)..(1): N-terminal acetylation
  MOD_RES (20)..(20): C-terminal amidation
FQSKGNVFVDGYGERLRAKL

SEQ ID NO: 498 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFGRLRAKL

SEQ ID NO: 499 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEGLRAKL

SEQ ID NO: 500 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLGAKL

SEQ ID NO: 501 - protein, 20 aa, Artificial Sequence
  Synthetic peptide
  MOD_RES (1)..(1): N-terminal acetylation
  MOD_RES (20)..(20): C-terminal amidation
HQSKGNVFVDGYFERLRAKL

SEQ ID NO: 502 - protein, 20 aa, Artificial Sequence
  Synthetic peptide
  MOD_RES (1)..(1): N-terminal acetylation
  MOD_RES (20)..(20): C-terminal amidation
FQSKGHVFVDGYFERLRAKL

SEQ ID NO: 503 - protein, 20 aa, Artificial Sequence
  Synthetic peptide
  MOD_RES (1)..(1): N-terminal acetylation
  MOD_RES (20)..(20): C-terminal amidation
FQSKGNHFVDGYFERLRAKL

SEQ ID NO: 504 - protein, 20 aa, Artificial Sequence
  Synthetic peptide
  MOD_RES (1)..(1): N-terminal acetylation
  MOD_RES (20)..(20): C-terminal amidation
FQSKGNVFVDHYFERLRAKL

SEQ ID NO: 505 - protein, 20 aa, Artificial Sequence
  Synthetic peptide
  MOD_RES (1)..(1): N-terminal acetylation
  MOD_RES (20)..(20): C-terminal amidation
FQSKGNVFVDGYHERLRAKL

SEQ ID NO: 506 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRHKL

SEQ ID NO: 507 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKH

SEQ ID NO: 508 - protein, 20 aa, Artificial Sequence
  Synthetic peptide
  MOD_RES (1)..(1): N-terminal acetylation
  MOD_RES (20)..(20): C-terminal amidation
FISKGNVFVDGYFERLRAKL

SEQ ID NO: 509 - protein, 20 aa, Artificial Sequence
  Synthetic peptide
  MOD_RES (1)..(1): N-terminal acetylation
  MOD_RES (20)..(20): C-terminal amidation
FQSKGNVFIDGYFERLRAKL

SEQ ID NO: 510 - protein, 20 aa, Artificial Sequence
  Synthetic peptide
  MOD_RES (1)..(1): N-terminal acetylation
  MOD_RES (20)..(20): C-terminal amidation
FQSKGNVFVDGYIERLRAKL

SEQ ID NO: 511 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRIKL

SEQ ID NO: 512 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKI

SEQ ID NO: 513 - protein, 20 aa, Artificial Sequence
  Synthetic peptide
  MOD_RES (1)..(1): N-terminal acetylation
  MOD_RES (20)..(20): C-terminal amidation
KQSKGNVFVDGYFERLRAKL

SEQ ID NO: 514 - protein, 20 aa, Artificial Sequence
  Synthetic peptide
  MOD_RES (1)..(1): N-terminal acetylation
  MOD_RES (20)..(20): C-terminal amidation
FQKKGNVFVDGYFERLRAKL

SEQ ID NO: 515 - protein, 20 aa, Artificial Sequence
  Synthetic peptide
  MOD_RES (1)..(1): N-terminal acetylation
  MOD_RES (20)..(20): C-terminal amidation
FQSKGNVFKDGYFERLRAKL

SEQ ID NO: 516 - protein, 20 aa, Artificial Sequence
  Synthetic peptide
  MOD_RES (1)..(1): N-terminal acetylation
  MOD_RES (20)..(20): C-terminal amidation
FQSKGNVFVDGYKERLRAKL

SEQ ID NO: 517 - protein, 20 aa, Artificial Sequence
  Synthetic peptide
  MOD_RES (1)..(1): N-terminal acetylation
  MOD_RES (20)..(20): C-terminal amidation
LQSKGNVFVDGYFERLRAKL

SEQ ID NO: 518 - protein, 20 aa, Artificial Sequence
  Synthetic peptide
  MOD_RES (1)..(1): N-terminal acetylation
  MOD_RES (20)..(20): C-terminal amidation
FQLKGNVFVDGYFERLRAKL

SEQ ID NO: 519 - protein, 20 aa, Artificial Sequence
  Synthetic peptide
  MOD_RES (1)..(1): N-terminal acetylation
  MOD_RES (20)..(20): C-terminal amidation
FQSKGNLFVDGYFERLRAKL

SEQ ID NO: 520 - protein, 20 aa, Artificial Sequence
  Synthetic peptide
  MOD_RES (1)..(1): N-terminal acetylation
  MOD_RES (20)..(20): C-terminal amidation
FQSKGNVFVDLYFERLRAKL

SEQ ID NO: 521 - protein, 20 aa, Artificial Sequence
  Synthetic peptide
  MOD_RES (1)..(1): N-terminal acetylation
  MOD_RES (20)..(20): C-terminal amidation
FQSKGNVFVDGLFERLRAKL

SEQ ID NO: 522 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFELLRAKL

SEQ ID NO: 523 - protein, 20 aa, Artificial Sequence
  Synthetic peptide
  MOD_RES (1)..(1): N-terminal acetylation
  MOD_RES (20)..(20): C-terminal amidation
FQSKGNVFVDGYMERLRAKL

SEQ ID NO: 524 - protein, 20 aa, Artificial Sequence
  Synthetic peptide
  MOD_RES (1)..(1): N-terminal acetylation
  MOD_RES (20)..(20): C-terminal amidation
NQSKGNVFVDGYFERLRAKL

SEQ ID NO: 525 - protein, 20 aa, Artificial Sequence
  Synthetic peptide
  MOD_RES (1)..(1): N-terminal acetylation
  MOD_RES (20)..(20): C-terminal amidation
FNSKGNVFVDGYFERLRAKL

SEQ ID NO: 526 - protein, 20 aa, Artificial Sequence
  Synthetic peptide
  MOD_RES (1)..(1): N-terminal acetylation
  MOD_RES (20)..(20): C-terminal amidation
FQSKGNVFVDGYNERLRAKL

SEQ ID NO: 527 - protein, 20 aa, Artificial Sequence
  Synthetic peptide
  MOD_RES (1)..(1): N-terminal acetylation
  MOD_RES (20)..(20): C-terminal amidation
FQSKGNPFVDGYFERLRAKL

SEQ ID NO: 528 - protein, 20 aa, Artificial Sequence
  Synthetic peptide
  MOD_RES (1)..(1): N-terminal acetylation
  MOD_RES (20)..(20): C-terminal amidation
FQSKGNVFVDPYFERLRAKL

SEQ ID NO: 529 - protein, 20 aa, Artificial Sequence
  Synthetic peptide
  MOD_RES (1)..(1): N-terminal acetylation
  MOD_RES (20)..(20): C-terminal amidation
FQSKGNVFVDGYPERLRAKL

SEQ ID NO: 530 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFPRLRAKL

SEQ ID NO: 531 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEPLRAKL

SEQ ID NO: 532 - protein, 20 aa, Artificial Sequence
  Synthetic peptide
  MOD_RES (1)..(1): N-terminal acetylation
  MOD_RES (20)..(20): C-terminal amidation
QQSKGNVFVDGYFERLRAKL

SEQ ID NO: 533 - protein, 20 aa, Artificial Sequence
  Synthetic peptide
  MOD_RES (1)..(1): N-terminal acetylation
  MOD_RES (20)..(20): C-terminal amidation
FQSKGNQFVDGYFERLRAKL

SEQ ID NO: 534 - protein, 20 aa, Artificial Sequence
  Synthetic peptide
  MOD_RES (1)..(1): N-terminal acetylation
  MOD_RES (20)..(20): C-terminal amidation
FQSKGNVFQDGYFERLRAKL

SEQ ID NO: 535 - protein, 20 aa, Artificial Sequence
  Synthetic peptide
  MOD_RES (1)..(1): N-terminal acetylation
  MOD_RES (20)..(20): C-terminal amidation
FQSKGNVFVDQYFERLRAKL

SEQ ID NO: 536 - protein, 20 aa, Artificial Sequence
  Synthetic peptide
  MOD_RES (1)..(1): N-terminal acetylation
  MOD_RES (20)..(20): C-terminal amidation
FQSKGNVFVDGYQERLRAKL

SEQ ID NO: 537 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEQLRAKL

SEQ ID NO: 538 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLQAKL

SEQ ID NO: 539 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKQ

SEQ ID NO: 540 - protein, 20 aa, Artificial Sequence
  Synthetic peptide
  MOD_RES (1)..(1): N-terminal acetylation
  MOD_RES (20)..(20): C-terminal amidation
RQSKGNVFVDGYFERLRAKL

SEQ ID NO: 541 - protein, 20 aa, Artificial Sequence
  Synthetic peptide
  MOD_RES (1)..(1): N-terminal acetylation
  MOD_RES (20)..(20): C-terminal amidation
FRSKGNVFVDGYFERLRAKL

SEQ ID NO: 542 - protein, 20 aa, Artificial Sequence
  Synthetic peptide
  MOD_RES (1)..(1): N-terminal acetylation
  MOD_RES (20)..(20): C-terminal amidation
FQSKGNRFVDGYFERLRAKL

SEQ ID NO: 543 - protein, 20 aa, Artificial Sequence
  Synthetic peptide
  MOD_RES (1)..(1): N-terminal acetylation
  MOD_RES (20)..(20): C-terminal amidation
FQSKGNVRVDGYFERLRAKL

SEQ ID NO: 544 - protein, 20 aa, Artificial Sequence
  Synthetic peptide
  MOD_RES (1)..(1): N-terminal acetylation
  MOD_RES (20)..(20): C-terminal amidation
FQSKGNVFRDGYFERLRAKL

SEQ ID NO: 545 - protein, 20 aa, Artificial Sequence
  Synthetic peptide
  MOD_RES (1)..(1): N-terminal acetylation
  MOD_RES (20)..(20): C-terminal amidation
FQSKGNVFVDGYRERLRAKL

SEQ ID NO: 546 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERRRAKL

SEQ ID NO: 547 - protein, 20 aa, Artificial Sequence
  Synthetic peptide
  MOD_RES (1)..(1): N-terminal acetylation
  MOD_RES (20)..(20): C-terminal amidation
FSSKGNVFVDGYFERLRAKL

SEQ ID NO: 548 - protein, 20 aa, Artificial Sequence
  Synthetic peptide
  MOD_RES (1)..(1): N-terminal acetylation
  MOD_RES (20)..(20): C-terminal amidation
FQSSGNVFVDGYFERLRAKL

SEQ ID NO: 549 - protein, 20 aa, Artificial Sequence
  Synthetic peptide
  MOD_RES (1)..(1): N-terminal acetylation
  MOD_RES (20)..(20): C-terminal amidation
FQSKGNSFVDGYFERLRAKL

SEQ ID NO: 550 - protein, 20 aa, Artificial Sequence
  Synthetic peptide
  MOD_RES (1)..(1): N-terminal acetylation
  MOD_RES (20)..(20): C-terminal amidation
FQSKGNVFSDGYFERLRAKL

SEQ ID NO: 551 - protein, 20 aa, Artificial Sequence
  Synthetic peptide
  MOD_RES (1)..(1): N-terminal acetylation
  MOD_RES (20)..(20): C-terminal amidation
FQSKGNVFVDSYFERLRAKL

SEQ ID NO: 552 - protein, 20 aa, Artificial Sequence
  Synthetic peptide
  MOD_RES (1)..(1): N-terminal acetylation
  MOD_RES (20)..(20): C-terminal amidation
FQSKGNVFVDGYSERLRAKL

SEQ ID NO: 553 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLSAKL

SEQ ID NO: 554 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRSKL

SEQ ID NO: 555 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKS

SEQ ID NO: 556 - protein, 20 aa, Artificial Sequence
  Synthetic peptide
  MOD_RES (1)..(1): N-terminal acetylation
  MOD_RES (20)..(20): C-terminal amidation
TQSKGNVFVDGYFERLRAKL

SEQ ID NO: 557 - protein, 20 aa, Artificial Sequence
  Synthetic peptide
  MOD_RES (1)..(1): N-terminal acetylation
  MOD_RES (20)..(20): C-terminal amidation
FQTKGNVFVDGYFERLRAKL

SEQ ID NO: 558 - protein, 20 aa, Artificial Sequence
  Synthetic peptide
  MOD_RES (1)..(1): N-terminal acetylation
  MOD_RES (20)..(20): C-terminal amidation
FQSTGNVFVDGYFERLRAKL

SEQ ID NO: 559 - protein, 20 aa, Artificial Sequence
  Synthetic peptide
  MOD_RES (1)..(1): N-terminal acetylation
  MOD_RES (20)..(20): C-terminal amidation
FQSKGTVFVDGYFERLRAKL

SEQ ID NO: 560 - protein, 20 aa, Artificial Sequence
  Synthetic peptide
  MOD_RES (1)..(1): N-terminal acetylation
  MOD_RES (20)..(20): C-terminal amidation
FQSKGNTFVDGYFERLRAKL

SEQ ID NO: 561 - protein, 20 aa, Artificial Sequence
  Synthetic peptide
  MOD_RES (1)..(1): N-terminal acetylation
  MOD_RES (20)..(20): C-terminal amidation
FQSKGNVFTDGYFERLRAKL

SEQ ID NO: 562 - protein, 20 aa, Artificial Sequence
  Synthetic peptide
  MOD_RES (1)..(1): N-terminal acetylation
  MOD_RES (20)..(20): C-terminal amidation
FQSKGNVFVDGYTERLRAKL

SEQ ID NO: 563 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRTKL

SEQ ID NO: 564 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKT

SEQ ID NO: 565 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVFGYFARLRAKL

SEQ ID NO: 566 - protein, 20 aa, Artificial Sequence
  Synthetic peptide
  MOD_RES (1)..(1): N-terminal acetylation
  MOD_RES (20)..(20): C-terminal amidation
FQSKGNVFVDGYVERLRAKL

SEQ ID NO: 567 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERVRAKL

SEQ ID NO: 568 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKV

SEQ ID NO: 569 - protein, 20 aa, Artificial Sequence
  Synthetic peptide
  MOD_RES (1)..(1): N-terminal acetylation
  MOD_RES (20)..(20): C-terminal amidation
FQWKGNVFVDGYFERLRAKL

SEQ ID NO: 570 - protein, 20 aa, Artificial Sequence
  Synthetic peptide
  MOD_RES (1)..(1): N-terminal acetylation
  MOD_RES (20)..(20): C-terminal amidation
FQSKGWVFVDGYFERLRAKL

SEQ ID NO: 571 - protein, 20 aa, Artificial Sequence
  Synthetic peptide
  MOD_RES (1)..(1): N-terminal acetylation
  MOD_RES (20)..(20): C-terminal amidation
FQSKGNWFVDGYFERLRAKL

SEQ ID NO: 572 - protein, 20 aa, Artificial Sequence
  Synthetic peptide
  MOD_RES (1)..(1): N-terminal acetylation
  MOD_RES (20)..(20): C-terminal amidation
FQSKGNVWVDGYFERLRAKL

SEQ ID NO: 573 - protein, 20 aa, Artificial Sequence
  Synthetic peptide
  MOD_RES (1)..(1): N-terminal acetylation
  MOD_RES (20)..(20): C-terminal amidation
FQSKGNVFWDGYFERLRAKL

SEQ ID NO: 574 - protein, 20 aa, Artificial Sequence
  Synthetic peptide
  MOD_RES (1)..(1): N-terminal acetylation
  MOD_RES (20)..(20): C-terminal amidation
FQSKGNVFVDWYFERLRAKL

SEQ ID NO: 575 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERWRAKL

SEQ ID NO: 576 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLWAKL

SEQ ID NO: 577 - protein, 20 aa, Artificial Sequence
  Synthetic peptide
  MOD_RES (1)..(1): N-terminal acetylation
  MOD_RES (20)..(20): C-terminal amidation
FQYKGNVFVDGYFERLRAKL

SEQ ID NO: 578 - protein, 20 aa, Artificial Sequence
  Synthetic peptide
  MOD_RES (1)..(1): N-terminal acetylation
  MOD_RES (20)..(20): C-terminal amidation
FQSKGNVFYDGYFERLRAKL

SEQ ID NO: 579 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRYKL

SEQ ID NO: 580 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKY

SEQ ID NO: 581 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLRAKL

SEQ ID NO: 582 - protein, 20 aa, Artificial Sequence
  Synthetic peptide
  MOD_RES (1)..(1): N-terminal acetylation
  MOD_RES (20)..(20): C-terminal amidation
FQSKINVFVDGYFERLRAKL

SEQ ID NO: 583 - protein, 20 aa, Artificial Sequence
  Synthetic peptide
  MOD_RES (1)..(1): N-terminal acetylation
  MOD_RES (20)..(20): C-terminal amidation
FQSKPNVFVDGYFERLRAKL

SEQ ID NO: 584 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLRAKL

SEQ ID NO: 585 - protein, 20 aa, Artificial Sequence
  Synthetic peptide
  MOD_RES (1)..(1): N-terminal acetylation
  MOD_RES (20)..(20): C-terminal amidation
FQSKTNVFVDGYFERLRAKL

SEQ ID NO: 586 - protein, 20 aa, Artificial Sequence
  Synthetic peptide
  MOD_RES (1)..(1): N-terminal acetylation
  MOD_RES (20)..(20): C-terminal amidation
FQSKVNVFVDGYFERLRAKL

SEQ ID NO: 587 - protein, 20 aa, Artificial Sequence
  Synthetic peptide
  MOD_RES (1)..(1): N-terminal acetylation
  MOD_RES (20)..(20): C-terminal amidation
FQSKWNVFVDGYFERLRAKL

SEQ ID NO: 588 - protein, 20 aa, Artificial Sequence
  Synthetic peptide
  MOD_RES (1)..(1): N-terminal acetylation
  MOD_RES (20)..(20): C-terminal amidation
FQSKGNVFVIGYFERLRAKL

SEQ ID NO: 589 - protein, 20 aa, Artificial Sequence
  Synthetic peptide
  MOD_RES (1)..(1): N-terminal acetylation
  MOD_RES (20)..(20): C-terminal amidation
FQSKGNVFVLGYFERLRAKL

SEQ ID NO: 590 - protein, 20 aa, Artificial Sequence
  Synthetic peptide
  MOD_RES (1)..(1): N-terminal acetylation
  MOD_RES (20)..(20): C-terminal amidation
FQSKGNVFVQGYFERLRAKL

SEQ ID NO: 591 - protein, 20 aa, Artificial Sequence
  Synthetic peptide
  MOD_RES (1)..(1): N-terminal acetylation
  MOD_RES (20)..(20): C-terminal amidation
FQSKFNVFVDGYFERLAAKL

SEQ ID NO: 592 - protein, 20 aa, Artificial Sequence
  Synthetic peptide
  MOD_RES (1)..(1): N-terminal acetylation
  MOD_RES (20)..(20): C-terminal amidation
FQSKYNVFVDGYHERLAAKL

SEQ ID NO: 593 - protein, 20 aa, Artificial Sequence
  Synthetic peptide
  MOD_RES (1)..(1): N-terminal acetylation
  MOD_RES (20)..(20): C-terminal amidation
FQSSHNVFVDGYFERLAAKL

SEQ ID NO: 594 - protein, 20 aa, Artificial Sequence
  Synthetic peptide
  MOD_RES (1)..(1): N-terminal acetylation
  MOD_RES (20)..(20): C-terminal amidation
FQSAKNVFVDGYFERLRAKL

SEQ ID NO: 595 - protein, 20 aa, Artificial Sequence
  Synthetic peptide
  MOD_RES (1)..(1): N-terminal acetylation
  MOD_RES (20)..(20): C-terminal amidation
FQSFKNVFVDGYFERLAAKL

SEQ ID NO: 596 - protein, 20 aa, Artificial Sequence
  Synthetic peptide
  MOD_RES (1)..(1): N-terminal acetylation
  MOD_RES (20)..(20): C-terminal amidation
FQDPKNVFVDGYFERLAAKL

SEQ ID NO: 597 - protein, 20 aa, Artificial Sequence
  Synthetic peptide
  MOD_RES (1)..(1): N-terminal acetylation
  MOD_RES (20)..(20): C-terminal amidation
FQSKVNVFVDGYFERLAAKL

SEQ ID NO: 598 - protein, 20 aa, Artificial Sequence
  Synthetic peptide
  MOD_RES (1)..(1): N-terminal acetylation
  MOD_RES (20)..(20): C-terminal amidation
FQSIKNVFVDGYFERLAAKL

SEQ ID NO: 599 - protein, 20 aa, Artificial Sequence
  Synthetic peptide
  MOD_RES (1)..(1): N-terminal acetylation
  MOD_RES (20)..(20): C-terminal amidation
FQSKTNIFVDGYFERLAAKL

SEQ ID NO: 600 - protein, 20 aa, Artificial Sequence
  Synthetic peptide
  MOD_RES (1)..(1): N-terminal acetylation
  MOD_RES (20)..(20): C-terminal amidation
FQSHYNVFVDGYFERLAAKL

SEQ ID NO: 601 - protein, 20 aa, Artificial Sequence
  Synthetic peptide
  MOD_RES (1)..(1): N-terminal acetylation
  MOD_RES (20)..(20): C-terminal amidation
FQSKENVFVDGYFDRLAAKL

SEQ ID NO: 602 - protein, 20 aa, Artificial Sequence
  Synthetic peptide
  MOD_RES (1)..(1): N-terminal acetylation
  MOD_RES (20)..(20): C-terminal amidation
FQSHHNVFVDGYFERLAAKL

SEQ ID NO: 603 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLAAKL

SEQ ID NO: 604 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLAFKL

SEQ ID NO: 605 - protein, 20 aa, Artificial Sequence
  Synthetic peptide
  MOD_RES (1)..(1): N-terminal acetylation
  MOD_RES (20)..(20): C-terminal amidation
FQSFKHVFVDGYFERLAAKL

SEQ ID NO: 606 - protein, 20 aa, Artificial Sequence
  Synthetic peptide
  MOD_RES (1)..(1): N-terminal acetylation
  MOD_RES (20)..(20): C-terminal amidation
FQSKANVHVDGYFERLAAKL

SEQ ID NO: 607 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLAAKL

SEQ ID NO: 608 - protein, 20 aa, Artificial Sequence
  Synthetic peptide
  MOD_RES (1)..(1): N-terminal acetylation
  MOD_RES (20)..(20): C-terminal amidation
FQSHKNVFVDGYFERLAAKL

SEQ ID NO: 609 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLAAKF

SEQ ID NO: 610 - protein, 20 aa, Artificial Sequence
  Synthetic peptide
  MOD_RES (1)..(1): N-terminal acetylation
  MOD_RES (20)..(20): C-terminal amidation
FQSKMNVFVDGYFERLAAKL

SEQ ID NO: 611 - protein, 20 aa, Artificial Sequence
  Synthetic peptide
  MOD_RES (1)..(1): N-terminal acetylation
  MOD_RES (20)..(20): C-terminal amidation
FQSAYNVFVDGYFERLAAKL

SEQ ID NO: 612 - protein, 20 aa, Artificial Sequence
  Synthetic peptide
  MOD_RES (1)..(1): N-terminal acetylation
  MOD_RES (20)..(20): C-terminal amidation
FQSKGNWFVDGYFERLAAKL

SEQ ID NO: 613 - protein, 20 aa, Artificial Sequence
  Synthetic peptide
  MOD_RES (1)..(1): N-terminal acetylation
  MOD_RES (20)..(20): C-terminal amidation
FQSAKNVFVDGYFVRLRAKL

SEQ ID NO: 614 - protein, 20 aa, Artificial Sequence
  Synthetic peptide
  MOD_RES (1)..(1): N-terminal acetylation
  MOD_RES (20)..(20): C-terminal amidation
FQSKTNVFVDGYFERLAAKL

SEQ ID NO: 615 - protein, 20 aa, Artificial Sequence
  Synthetic peptide
  MOD_RES (1)..(1): N-terminal acetylation
  MOD_RES (20)..(20): C-terminal amidation
FQSKHVVFVDGYFERLAAKL

SEQ ID NO: 616 - protein, 20 aa, Artificial Sequence
  Synthetic peptide
  MOD_RES (1)..(1): N-terminal acetylation
  MOD_RES (20)..(20): C-terminal amidation
FQSKKHVFVDGYFERLAAKL

SEQ ID NO: 617 - protein, 20 aa, Artificial Sequence
  Synthetic peptide
  MOD_RES (1)..(1): N-terminal acetylation
  MOD_RES (20)..(20): C-terminal amidation
FQSDKNVFVDGYFERLAAKL

SEQ ID NO: 618 - protein, 20 aa, Artificial Sequence
  Synthetic peptide
  MOD_RES (1)..(1): N-terminal acetylation
  MOD_RES (20)..(20): C-terminal amidation
FQSNKNVFVDGYFERLAAKL

SEQ ID NO: 619 - protein, 20 aa, Artificial Sequence
  Synthetic peptide
  MOD_RES (1)..(1): N-terminal acetylation
  MOD_RES (20)..(20): C-terminal amidation
FQSHKNVFVEGYFERLAAKL

SEQ ID NO: 620 - protein, 20 aa, Artificial Sequence
  Synthetic peptide
  MOD_RES (1)..(1): N-terminal acetylation
  MOD_RES (20)..(20): C-terminal amidation
FQSYKDVFVDGYFERLATKL

SEQ ID NO: 621 - protein, 20 aa, Artificial Sequence
  Synthetic peptide
  MOD_RES (1)..(1): N-terminal acetylation
  MOD_RES (20)..(20): C-terminal amidation
FQSKNNFFVDGYFERLAARL

SEQ ID NO: 622 - protein, 20 aa, Artificial Sequence
  Synthetic peptide
  MOD_RES (1)..(1): N-terminal acetylation
  MOD_RES (20)..(20): C-terminal amidation
FQSEQNVFVDGYFERLAAKL

SEQ ID NO: 623 - protein, 20 aa, Artificial Sequence
  Synthetic peptide
  MOD_RES (1)..(1): N-terminal acetylation
  MOD_RES (20)..(20): C-terminal amidation
FQSEHNVFVDGYFERLAAKL

SEQ ID NO: 624 - protein, 20 aa, Artificial Sequence
  Synthetic peptide
  MOD_RES (1)..(1): N-terminal acetylation
  MOD_RES (20)..(20): C-terminal amidation
FQSEKNVFVDGYFERLAAKL

SEQ ID NO: 625 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLAFKL

SEQ ID NO: 626 - protein, 20 aa, Artificial Sequence
  Synthetic peptide
  MOD_RES (1)..(1): N-terminal acetylation
  MOD_RES (20)..(20): C-terminal amidation
FQSKRNVFVDGYFERLAAKL

SEQ ID NO: 627 - protein, 20 aa, Artificial Sequence
  Synthetic peptide
  MOD_RES (1)..(1): N-terminal acetylation
  MOD_RES (20)..(20): C-terminal amidation
FQSGKNVFVDGYFERLAAKL

SEQ ID NO: 628 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLFAKL

SEQ ID NO: 629 - protein, 20 aa, Artificial Sequence
  Synthetic peptide
  MOD_RES (1)..(1): N-terminal acetylation
  MOD_RES (20)..(20): C-terminal amidation
FCSKGNVFVDGYFERLRAKL

SEQ ID NO: 630 - protein, 20 aa, Artificial Sequence
  Synthetic peptide
  MOD_RES (1)..(1): N-terminal acetylation
  MOD_RES (20)..(20): C-terminal amidation
FQSCGNVFVDGYFERLRAKL

SEQ ID NO: 631 - protein, 20 aa, Artificial Sequence
  Synthetic peptide
  MOD_RES (1)..(1): N-terminal acetylation
  MOD_RES (20)..(20): C-terminal amidation
FQSKGNCFVDGYFERLRAKL

SEQ ID NO: 632 - protein, 20 aa, Artificial Sequence
  Synthetic peptide
  MOD_RES (1)..(1): N-terminal acetylation
  MOD_RES (20)..(20): C-terminal amidation
FQSKGNVFVCGYFERLRAKL

SEQ ID NO: 633 - protein, 20 aa, Artificial Sequence
  Synthetic peptide
  MOD_RES (1)..(1): N-terminal acetylation
  MOD_RES (20)..(20): C-terminal amidation
FQSKGNVFVDCYFERLRAKL

SEQ ID NO: 634 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERCRAKL

SEQ ID NO: 635 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKC

SEQ ID NO: 636 - protein, 20 aa, Artificial Sequence
  Synthetic peptide
  MOD_RES (1)..(1): N-terminal acetylation
  MOD_RES (20)..(20): C-terminal amidation
FQSFKNVFVDGYFERLCAKL

SEQ ID NO: 637 - protein, 20 aa, Artificial Sequence
  Synthetic peptide
  MOD_RES (1)..(1): N-terminal acetylation
  MOD_RES (20)..(20): C-terminal amidation
FQSKVNVFVDGYFERLCAKL

SEQ ID NO: 638 - protein, 20 aa, Artificial Sequence
  Synthetic peptide
  MOD_RES (1)..(1): N-terminal acetylation
  MOD_RES (20)..(20): C-terminal amidation
FQSIKNVFVDGYFERLCAKL

SEQ ID NO: 639 - protein, 20 aa, Artificial Sequence
  Synthetic peptide
  MOD_RES (1)..(1): N-terminal acetylation
  MOD_RES (20)..(20): C-terminal amidation
FQSKERVFVDGYFERLCAKL

SEQ ID NO: 640 - protein, 20 aa, Artificial Sequence
  Synthetic peptide
  MOD_RES (1)..(1): N-terminal acetylation
  MOD_RES (20)..(20): C-terminal amidation
FQSKENVFVDGYFDRLCAKL

SEQ ID NO: 641 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLCIKL

SEQ ID NO: 642 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLCVKL

SEQ ID NO: 643 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLCAKL

SEQ ID NO: 644 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLCFKL

SEQ ID NO: 645 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLCAKL

SEQ ID NO: 646 - protein, 20 aa, Artificial Sequence
  Synthetic peptide
  MOD_RES (1)..(1): N-terminal acetylation
  MOD_RES (20)..(20): C-terminal amidation
FQSFKHVFVDGYFERLCAKL

SEQ ID NO: 647 - protein, 20 aa, Artificial Sequence
  Synthetic peptide
  MOD_RES (1)..(1): N-terminal acetylation
  MOD_RES (20)..(20): C-terminal amidation
LQSKTNVFVDGYFERLCAKL

SEQ ID NO: 648 - protein, 20 aa, Artificial Sequence
  Synthetic peptide
  MOD_RES (1)..(1): N-terminal acetylation
  MOD_RES (20)..(20): C-terminal amidation
FQSKCNVFVDGYFERLCAKL

SEQ ID NO: 649 - protein, 20 aa, Artificial Sequence
  Synthetic peptide
  MOD_RES (1)..(1): N-terminal acetylation
  MOD_RES (20)..(20): C-terminal amidation
FQSKFNVFVDGYTERLCAKL

SEQ ID NO: 650 - protein, 20 aa, Artificial Sequence
  Synthetic peptide
  MOD_RES (1)..(1): N-terminal acetylation
  MOD_RES (20)..(20): C-terminal amidation
FQSVKNVFVDGYFERLCAKL

SEQ ID NO: 651 - protein, 20 aa, Artificial Sequence
  Synthetic peptide
  MOD_RES (1)..(1): N-terminal acetylation
  MOD_RES (20)..(20): C-terminal amidation
FQSKGNWFVDGYFERLCAKL

SEQ ID NO: 652 - protein, 20 aa, Artificial Sequence
  Synthetic peptide
  MOD_RES (1)..(1): N-terminal acetylation
  MOD_RES (20)..(20): C-terminal amidation
FQSKVAVFVDGYFERLCAKL

SEQ ID NO: 653 - protein, 20 aa, Artificial Sequence
  Synthetic peptide
  MOD_RES (1)..(1): N-terminal acetylation
  MOD_RES (20)..(20): C-terminal amidation
FQSCKNVFVDGYFVRLRAKL

SEQ ID NO: 654 - protein, 20 aa, Artificial Sequence
  Synthetic peptide
  MOD_RES (1)..(1): N-terminal acetylation
  MOD_RES (20)..(20): C-terminal amidation
FQSKTNVFVDGYFERLCAKL

SEQ ID NO: 655 - protein, 20 aa, Artificial Sequence
  Synthetic peptide
  MOD_RES (1)..(1): N-terminal acetylation
  MOD_RES (20)..(20): C-terminal amidation
FQSKKDVFVDGYFERLCAKL

SEQ ID NO: 656 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLCARL

SEQ ID NO: 657 - protein, 20 aa, Artificial Sequence
  Synthetic peptide
  MOD_RES (1)..(1): N-terminal acetylation
  MOD_RES (20)..(20): C-terminal amidation
FQSDKNVFVDGYFERLCAKL

SEQ ID NO: 658 - protein, 20 aa, Artificial Sequence
  Synthetic peptide
  MOD_RES (1)..(1): N-terminal acetylation
  MOD_RES (20)..(20): C-terminal amidation
FQSHKNVFVEGYFERLCAKL

SEQ ID NO: 659 - protein, 20 aa, Artificial Sequence
  Synthetic peptide
  MOD_RES (1)..(1): N-terminal acetylation
  MOD_RES (20)..(20): C-terminal amidation
FQSKPNVFVDGYFERLCAKL

SEQ ID NO: 660 - protein, 20 aa, Artificial Sequence
  Synthetic peptide
  MOD_RES (1)..(1): N-terminal acetylation
  MOD_RES (20)..(20): C-terminal amidation
FQSYKDVFVDGYFERLCTKL

SEQ ID NO: 661 - protein, 20 aa, Artificial Sequence
  Synthetic peptide
  MOD_RES (1)..(1): N-terminal acetylation
  MOD_RES (20)..(20): C-terminal amidation
FQSKLNVFVDGYFERLCAKL

SEQ ID NO: 662 - protein, 20 aa, Artificial Sequence
  Synthetic peptide
  MOD_RES (1)..(1): N-terminal acetylation
  MOD_RES (20)..(20): C-terminal amidation
FQSKNNFFVDGYFERLCARL

SEQ ID NO: 663 - protein, 20 aa, Artificial Sequence
  Synthetic peptide
  MOD_RES (1)..(1): N-terminal acetylation
  MOD_RES (20)..(20): C-terminal amidation
FQSKYNIFVDGYFERLCAKL

SEQ ID NO: 664 - protein, 20 aa, Artificial Sequence
  Synthetic peptide
  MOD_RES (1)..(1): N-terminal acetylation
  MOD_RES (20)..(20): C-terminal amidation
HQQFKNVFVDGYFERLCAKL

SEQ ID NO: 665 - protein, 20 aa, Artificial Sequence
  Synthetic peptide
  MOD_RES (1)..(1): N-terminal acetylation
  MOD_RES (3)..(3): Xaa is 2-Amino-isobutyric acid
  MOD_RES (17)..(17): Xaa is 2-Amino-isobutyric acid
  MOD_RES (20)..(20): C-terminal amidation
FQXKGNVFVDGYFERLXAKL

SEQ ID NO: 666 - protein, 20 aa, Artificial Sequence
  Synthetic peptide
  MOD_RES (1)..(1): N-terminal acetylation
  MOD_RES (6)..(6): Xaa is 2-Amino-isobutyric acid
  MOD_RES (17)..(17): Xaa is 2-Amino-isobutyric acid
  MOD_RES (20)..(20): C-terminal amidation
FQSKGXVFVDGYFERLXAKL

SEQ ID NO: 667 - protein, 20 aa, Artificial Sequence
  Synthetic peptide
  MOD_RES (1)..(1): N-terminal acetylation
  MOD_RES (9)..(9): Xaa is 2-Amino-isobutyric acid
  MOD_RES (17)..(17): Xaa is 2-Amino-isobutyric acid
  MOD_RES (20)..(20): C-terminal amidation
FQSKGNVFXDGYFERLXAKL

SEQ ID NO: 668 - protein, 20 aa, Artificial Sequence
  Synthetic peptide
  MOD_RES (1)..(1): N-terminal acetylation
  misc_feature (10)..(10): Xaa can be any naturally occurring amino acid
  MOD_RES (11)..(11): Xaa is 2-Amino-isobutyric acid
  MOD_RES (17)..(17): Xaa is 2-Amino-isobutyric acid
  MOD_RES (20)..(20): C-terminal amidation
FQSKGNVFVXGYFERLXAKL

SEQ ID NO: 669 - protein, 20 aa, Artificial Sequence
  Synthetic peptide
  MOD_RES (1)..(1): N-terminal acetylation
  MOD_RES (11)..(11): Xaa is 2-Amino-isobutyric acid
  MOD_RES (17)..(17): Xaa is 2-Amino-isobutyric acid
  MOD_RES (20)..(20): C-terminal amidation
FQSKGNVFVDXYFERLXAKL

SEQ ID NO: 670 - protein, 20 aa, Artificial Sequence
  Synthetic peptide
  MOD_RES (1)..(1): N-terminal acetylation
  DISULFID (5)..(17): Cys residues linked via disulfide bond
  MOD_RES (20)..(20): C-terminal amidation
FQSKCNVFVDGYFERLCAKL

SEQ ID NO: 671 - protein, 20 aa, Artificial Sequence
  Synthetic peptide
  MOD_RES (1)..(1): N-terminal acetylation
  DISULFID (10)..(17): Cys residues linked via disulfide bond
  MOD_RES (20)..(20): C-terminal amidation
FQSKGNVFVCGYFERLCAKL

SEQ ID NO: 672 - protein, 20 aa, Artificial Sequence
  Synthetic peptide
  MOD_RES (1)..(1): N-terminal acetylation
  MOD_RES (20)..(20): C-terminal amidation
FQSKKNNFVFGYFERLRAKL

SEQ ID NO: 673 - protein, 20 aa, Artificial Sequence
  Synthetic peptide
  MOD_RES (1)..(1): N-terminal acetylation
  MOD_RES (20)..(20): C-terminal amidation
FQSKKNVVVFGYFERLRAKL

SEQ ID NO: 674 - protein, 20 aa, Artificial Sequence
  Synthetic peptide
  MOD_RES (1)..(1): N-terminal acetylation
  MOD_RES (20)..(20): C-terminal amidation
FQSKKNVFQFGYFERLRAKL

SEQ ID NO: 675 - protein, 20 aa, Artificial Sequence
  Synthetic peptide
  MOD_RES (1)..(1): N-terminal acetylation
  MOD_RES (3)..(3): (S)-N-methyl-Ser
  MOD_RES (20)..(20): C-terminal amidation
FQSKGNVFVFGYFERLRAKL

SEQ ID NO: 676 - protein, 20 aa, Artificial Sequence
  Synthetic peptide
  MOD_RES (1)..(1): N-terminal acetylation
  MOD_RES (9)..(9): (S)-N-methyl-Val
  MOD_RES (20)..(20): C-terminal amidation
FQSKGNVFVFGYFERLRAKL

SEQ ID NO: 677 - protein, 20 aa, Artificial Sequence
  Synthetic peptide
  MOD_RES (1)..(1): N-terminal acetylation
  MOD_RES (13)..(13): (S)-N-methyl-Phe
  MOD_RES (20)..(20): C-terminal amidation
FQSKGNVFVFGYFERLRAKL

SEQ ID NO: 678 - protein, 20 aa, Artificial Sequence
  Synthetic peptide
  MOD_RES (1)..(1): N-terminal acetylation
  MOD_RES (14)..(14): (S)-N-methyl-Glu
  MOD_RES (20)..(20): C-terminal amidation
FQSKGNVFVFGYFERLRAKL

SEQ ID NO: 679 - protein, 20 aa, Artificial Sequence
  Synthetic peptide
  MOD_RES (1)..(1): N-terminal acetylation
  MOD_RES (18)..(18): (S)-N-methyl-Ala
  MOD_RES (20)..(20): C-terminal amidation
FQSKGNVFVFGYFERLRAKL

SEQ ID NO: 680 - protein, 20 aa, Artificial Sequence
  Synthetic peptide
  MOD_RES (1)..(1): N-terminal acetylation
  MOD_RES (2)..(2): beta-Homoglutamine
  MOD_RES (20)..(20): C-terminal amidation
FESKGNVFVFGYFERLRAKL

SEQ ID NO: 681 - protein, 20 aa, Artificial Sequence
  Synthetic peptide
  MOD_RES (1)..(1): N-terminal acetylation
  MOD_RES (8)..(8): beta-Homophenylalanine
  MOD_RES (20)..(20): C-terminal amidation
FQSKGNVFVFGYFERLRAKL

SEQ ID NO: 682 - protein, 20 aa, Artificial Sequence
  Synthetic peptide
  MOD_RES (1)..(1): N-terminal acetylation
  MOD_RES (10)..(10): beta-Homophenylalanine
  MOD_RES (20)..(20): C-terminal amidation
FQSKGNVFVFGYFERLRAKL

SEQ ID NO: 683 - protein, 20 aa, Artificial Sequence
  Synthetic peptide
  MOD_RES (1)..(1): N-terminal acetylation
  MOD_RES (13)..(13): beta-Homophenylalanine
  MOD_RES (20)..(20): C-terminal amidation
FQSKGNVFVFGYFERLRAKL

SEQ ID NO: 684 - protein, 20 aa, Artificial Sequence
  Synthetic peptide
  MOD_RES (1)..(1): N-terminal acetylation
  MOD_RES (16)..(16): beta-Homoleucine
  MOD_RES (20)..(20): C-terminal amidation
FQSKGNVFVFGYFERLRAKL

SEQ ID NO: 685 - protein, 20 aa, Artificial Sequence
  Synthetic peptide
  MOD_RES (1)..(1): N-terminal acetylation
  MOD_RES (15)..(15): Xaa is (S)-Citrullin
  MOD_RES (20)..(20): C-terminal amidation
FQSKGNVFVFGYFEXLRAKL

SEQ ID NO: 686 - protein, 20 aa, Artificial Sequence
  Synthetic peptide
  MOD_RES (1)..(1): N-terminal acetylation
  MOD_RES (20)..(20): C-terminal amidation
FQSKKNVGVFGYFERLRAKL

SEQ ID NO: 687 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERGRAKL

SEQ ID NO: 688 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAGL

SEQ ID NO: 689 - protein, 20 aa, Artificial Sequence
  Synthetic peptide
  MOD_RES (1)..(1): N-terminal acetylation
  MOD_RES (20)..(20): C-terminal amidation
FQSKKNVFVFGKFERLRAKL

SEQ ID NO: 690 - protein, 20 aa, Artificial Sequence
  Synthetic peptide
  MOD_RES (1)..(1): N-terminal acetylation
  MOD_RES (20)..(20): C-terminal amidation
FQSKFNVFVFGYFERLRAKL

SEQ ID NO: 691 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRFKL

SEQ ID NO: 692 - protein, 20 aa, Artificial Sequence
  Synthetic peptide
  MOD_RES (1)..(1): N-terminal acetylation
  MOD_RES (20)..(20): C-terminal amidation
LQSKKNVFVFGYFERLRAKL

SEQ ID NO: 693 - protein, 20 aa, Artificial Sequence
  Synthetic peptide
  MOD_RES (1)..(1): N-terminal acetylation
  MOD_RES (20)..(20): C-terminal amidation
FQSKKNVFVFGYLERLRAKL

SEQ ID NO: 694 - protein, 20 aa, Artificial Sequence
  Synthetic peptide
  MOD_RES (1)..(1): N-terminal acetylation
  MOD_RES (20)..(20): C-terminal amidation
FQSKGNVFLFGYFERLRAKL

SEQ ID NO: 695 - protein, 20 aa, Artificial Sequence
  Synthetic peptide
  MOD_RES (1)..(1): N-terminal acetylation
  MOD_RES (20)..(20): C-terminal amidation
FASKKNVFVFGYFERLRAKL

SEQ ID NO: 696 - protein, 20 aa, Artificial Sequence
  Synthetic peptide
  MOD_RES (1)..(1): N-terminal acetylation
  MOD_RES (20)..(20): C-terminal amidation
FQSKKPVFVFGYFERLRAKL

SEQ ID NO: 697 - protein, 20 aa, Artificial Sequence
  Synthetic peptide
  MOD_RES (1)..(1): N-terminal acetylation
  MOD_RES (20)..(20): C-terminal amidation
FQSKKNVFVFSYFERLRAKL

SEQ ID NO: 698 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRLKL

SEQ ID NO: 699 - protein, 20 aa, Artificial Sequence
  Synthetic peptide
  MOD_RES (1)..(1): N-terminal acetylation
  MOD_RES (3)..(3): D-Ser
  MOD_RES (20)..(20): N-terminal acetylation
FQSKKNVFVFGYFERLRAKL

SEQ ID NO: 700 - protein, 20 aa, Artificial Sequence
  Synthetic peptide
  MOD_RES (1)..(1): N-terminal acetylation
  MOD_RES (13)..(13): D-Phe
  MOD_RES (20)..(20): C-terminal amidation
FQSKKNVFVFGYFERLRAKL

SEQ ID NO: 701 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRGKL

SEQ ID NO: 702 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRKKL

SEQ ID NO: 703 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKK

SEQ ID NO: 704 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKANVFVTGYFERLXAKL

SEQ ID NO: 705 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLGAKL

SEQ ID NO: 706 - protein, 20 aa, Artificial Sequence
  Synthetic peptide
  MOD_RES (1)..(1): N-terminal acetylation
  MOD_RES (20)..(20): C-terminal amidation
FQSVKNVFVDGYFERLAAKL

SEQ ID NO: 707 - protein, 20 aa, Artificial Sequence
  Synthetic peptide
  MOD_RES (1)..(1): N-terminal acetylation
  MOD_RES (20)..(20): C-terminal amidation
FQSKVAVFVDGYFERLAAKL

SEQ ID NO: 708 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLCYKL

SEQ ID NO: 709 - protein, 20 aa, Artificial Sequence
  Synthetic peptide
  MOD_RES (1)..(1): N-terminal acetylation
  MOD_RES (20)..(20): C-terminal amidation
FQSTKNVFVDGYFERLCAKL

SEQ ID NO: 710 - protein, 20 aa, Artificial Sequence
  Synthetic peptide
  MOD_RES (1)..(1): N-terminal acetylation
  MOD_RES (2)..(2): Xaa is 2-Amino-isobutyric acid
  MOD_RES (17)..(17): Xaa is 2-Amino-isobutyric acid
  MOD_RES (20)..(20): C-terminal amidation
FXSKGNVFVDGYFERLXAKL

SEQ ID NO: 711 - protein, 20 aa, Artificial Sequence
  Synthetic peptide
  MOD_RES (1)..(1): N-terminal acetylation
  MOD_RES (7)..(7): Xaa is 2-Amino-isobutyric acid
  MOD_RES (17)..(17): Xaa is 2-Amino-isobutyric acid
  MOD_RES (20)..(20): C-terminal amidation
FQSKGNXFVDGYFERLXAKL

SEQ ID NO: 712 - protein, 23 aa, Artificial Sequence
  Synthetic peptide
  MOD_RES (1)..(1): N-terminal acetylation
  MOD_RES (23)..(23): C-terminal amidation
KKKKNVFVFGYFERLRAKLTSKK

SEQ ID NO: 713 - protein, 20 aa, Artificial Sequence
  Synthetic peptide
  MOD_RES (1)..(1): N-terminal acetylation
  MOD_RES (20)..(20): C-terminal amidation
FSSKKNVFVFGYFERLRAKL

SEQ ID NO: 714 - protein, 20 aa, Artificial Sequence
  Synthetic peptide
  MOD_RES (1)..(1): N-terminal acetylation
  MOD_RES (12)..(12): (S)-N-methyl-Tyr
  MOD_RES (20)..(20): C-terminal amidation
FQSKGNVFVFGYFERLRAKL

SEQ ID NO: 715 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERKRAKL

SEQ ID NO: 716 - protein, 20 aa, Artificial Sequence
  Synthetic peptide
  MOD_RES (1)..(1): N-terminal acetylation
  MOD_RES (20)..(20): C-terminal amidation
FQSKKNVFVFDYFERLRAKL

SEQ ID NO: 717 - protein, 20 aa, Artificial Sequence
  Synthetic peptide
  MOD_RES (1)..(1): N-terminal acetylation
  MOD_RES (20)..(20): C-terminal amidation
FQSKKNVFVFGYDERLRAKL

SEQ ID NO: 718 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRADL

SEQ ID NO: 719 - protein, 20 aa, Artificial Sequence
  Synthetic peptide
  MOD_RES (1)..(1): N-terminal acetylation
  MOD_RES (20)..(20): C-terminal amidation
FQSKKNVLVFGYFERLRAKL

SEQ ID NO: 720 - protein, 20 aa, Artificial Sequence
  Synthetic peptide
FQSKGNVFVFGYFERLRAKL

SEQ ID NO: 721 - protein, 20 aa, Artificial Sequence
  Synthetic peptide
  MOD_RES (1)..(1): N-terminal acetylation
  MOD_RES (20)..(20): C-terminal amidation
AQSKKNVFVFGYFERLRAKL

SEQ ID NO: 722 - protein, 20 aa, Artificial Sequence
  Synthetic peptide
  MOD_RES (1)..(1): N-terminal acetylation
  MOD_RES (20)..(20): C-terminal amidation
FQSKPNVFVFGYFERLRAKL

SEQ ID NO: 723 - protein, 20 aa, Artificial Sequence
  Synthetic peptide
  MOD_RES (1)..(1): N-terminal acetylation
  MOD_RES (20)..(20): C-terminal amidation
FQSKKNVFPFGYFERLRAKL

SEQ ID NO: 724 - protein, 20 aa, Artificial Sequence
  Synthetic peptide
  MOD_RES (1)..(1): N-terminal acetylation
  MOD_RES (20)..(20): C-terminal amidation
FQSKKNSFVFGYFERLRAKL

SEQ ID NO: 725 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLLAKL

SEQ ID NO: 726 - protein, 20 aa, Artificial Sequence
  Synthetic peptide
  MOD_RES (1)..(1): N-terminal acetylation
  MOD_RES (1)..(1): D-Phe
  MOD_RES (20)..(20): C-terminal amidation
FQSKKNVFVFGYFERLRAKL

SEQ ID NO: 727 - protein, 20 aa, Artificial Sequence
  Synthetic peptide
  MOD_RES (1)..(1): N-terminal acetylation
  MOD_RES (2)..(2): D-Gln
  MOD_RES (20)..(20): C-terminal amidation
FQSKKNVFVFGYFERLRAKL

SEQ ID NO: 728 - protein, 20 aa, Artificial Sequence
  Synthetic peptide
  MOD_RES (1)..(1): N-terminal acetylation
  MOD_RES (6)..(6): D-Asn
  MOD_RES (20)..(20): C-terminal amidation
FQSKKNVFVFGYFERLRAKL

SEQ ID NO: 729 - protein, 20 aa, Artificial Sequence
  Synthetic peptide
  MOD_RES (1)..(1): N-terminal acetylation
  MOD_RES (7)..(7): D-Val
  MOD_RES (20)..(20): C-terminal amidation
FQSKKNVFVFGYFERLRAKL

SEQ ID NO: 730 - protein, 20 aa, Artificial Sequence
  Synthetic peptide
  MOD_RES (1)..(1): N-terminal acetylation
  MOD_RES (8)..(8): D-Phe
  MOD_RES (20)..(20): C-terminal amidation
FQSKKNVFVFGYFERLRAKL

SEQ ID NO: 731 - protein, 20 aa, Artificial Sequence
  Synthetic peptide
  MOD_RES (1)..(1): N-terminal acetylation
  MOD_RES (20)..(20): C-terminal amidation
FQSKGNVFADGYFERLRAKL

SEQ ID NO: 732 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKA

SEQ ID NO: 733 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKN

SEQ ID NO: 734 - protein, 20 aa, Artificial Sequence
  Synthetic peptide
  MOD_RES (1)..(1): N-terminal acetylation
  MOD_RES (20)..(20): C-terminal amidation
SQSKGNVFVDGYFERLRAKL

SEQ ID NO: 735 - protein, 20 aa, Artificial Sequence
  Synthetic peptide
  MOD_RES (1)..(1): N-terminal acetylation
  MOD_RES (20)..(20): C-terminal amidation
FQSKKNVFFFGYFERLRAKL

SEQ ID NO: 736 - protein, 20 aa, Artificial Sequence
  Synthetic peptide
  MOD_RES (1)..(1): N-terminal acetylation
  MOD_RES (20)..(20): C-terminal amidation
FQSKKDVFVDGYFERLAAKL

SEQ ID NO: 737 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLAARL

SEQ ID NO: 738 - protein, 20 aa, Artificial Sequence
  Synthetic peptide
  MOD_RES (1)..(1): N-terminal acetylation
  MOD_RES (20)..(20): C-terminal amidation
FQSTKNVFVDGYFERLAAKL

SEQ ID NO: 739 - protein, 20 aa, Artificial Sequence
  Synthetic peptide
  MOD_RES (1)..(1): N-terminal acetylation
  MOD_RES (20)..(20): C-terminal amidation
YQSKQNVFVDGYFERLAAKL

SEQ ID NO: 740 - protein, 20 aa, Artificial Sequence
  Synthetic peptide
  MOD_RES (1)..(1): N-terminal acetylation
  MOD_RES (20)..(20): C-terminal amidation
FQSFENVFVDGYFERLHAKL

SEQ ID NO: 741 - protein, 20 aa, Artificial Sequence
  Synthetic peptide
  MOD_RES (1)..(1): N-terminal acetylation
  MOD_RES (1)..(1): Xaa is 2-Amino-isobutyric acid
  MOD_RES (17)..(17): Xaa is 2-Amino-isobutyric acid
  MOD_RES (20)..(20): C-terminal amidation
XQSKGNVFVDGYFERLXAKL

SEQ ID NO: 742 - protein, 30 aa, Artificial Sequence
  Synthetic peptide
  MOD_RES (1)..(1): N-terminal acetylation
  MOD_RES (30)..(30): C-terminal amidation
VVEKLTFVQLSFLNRRRFSQYAGFKGAGKV

SEQ ID NO: 743 - protein, 30 aa, Artificial Sequence
  Synthetic peptide
  MOD_RES (1)..(1): N-terminal acetylation
  MOD_RES (30)..(30): C-terminal amidation
RVFLYFSGKAGGLVKLVERQAFQTNVSKFR

SEQ ID NO: 744 - protein, 29 aa, Artificial Sequence
  Synthetic peptide
  MOD_RES (1)..(1): N-terminal acetylation
  MOD_RES (29)..(29): C-terminal amidation
KKSGVGRLQVAFQSKKNVFVFGYFERLKK

SEQ ID NO: 745 - protein, 26 aa, Artificial Sequence
  Synthetic peptide
  MOD_RES (1)..(1): N-terminal acetylation
  MOD_RES (26)..(26): C-terminal amidation
KKSGVGRLQVAFQSKKNVFVFGYFKK

SEQ ID NO: 746 - protein, 23 aa, Artificial Sequence
  Synthetic peptide
  MOD_RES (1)..(1): N-terminal acetylation
  MOD_RES (23)..(23): C-terminal amidation
KKSGVGRLQVAFQSKKNVFVFKK

SEQ ID NO: 747 - protein, 20 aa, Artificial Sequence
  Synthetic peptide
  MOD_RES (1)..(1): N-terminal acetylation
  MOD_RES (20)..(20): C-terminal amidation
FQSKQNVFVFGYFERLRAKL

SEQ ID NO: 748 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKN

SEQ ID NO: 749 - protein, 19 aa, Artificial Sequence
  Synthetic peptide
  MOD_RES (1)..(1): N-terminal acetylation
  MOD_RES (19)..(19): C-terminal amidation
FQSKKNVFVFGYFERLRAK

SEQ ID NO: 750 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFELLRAKL

SEQ ID NO: 751 - protein, 20 aa, Artificial Sequence
  Synthetic peptide
  MOD_RES (1)..(1): N-terminal acetylation
  MOD_RES (8)..(8): (S)-methyl-Phe
  MOD_RES (20)..(20): C-terminal amidation
FQSKGNVFVFGYFERLRAKL

SEQ ID NO: 752 - protein, 20 aa, Artificial Sequence
  Synthetic peptide
  MOD_RES (1)..(1): N-terminal acetylation
  MOD_RES (15)..(15): (S)-methyl-Arg
  MOD_RES (20)..(20): C-terminal amidation
FQSKGNVFVFGYFERLRAKL

SEQ ID NO: 753 - protein, 20 aa, Artificial Sequence
  Synthetic peptide
  MOD_RES (1)..(1): N-terminal acetylation
  MOD_RES (16)..(16): (S)-N-methyl-Leu
  MOD_RES (20)..(20): C-terminal amidation
FQSKGNVFVFGYFERLRAKL

SEQ ID NO: 754 - protein, 20 aa, Artificial Sequence
  Synthetic peptide
  MOD_RES (1)..(1): N-terminal acetylation
  MOD_RES (17)..(17): (S)-N-methyl-Arg
  MOD_RES (20)..(20): C-terminal amidation
FQSKGNVFVFGYFERLRAKL

SEQ ID NO: 755 - protein, 20 aa, Artificial Sequence
  Synthetic peptide
  MOD_RES (1)..(1): N-terminal acetylation
  MOD_RES (19)..(19): (S)-N-methyl-Lys
  MOD_RES (20)..(20): C-terminal amidation
FQSKGNVFVFGYFERLRAKL

SEQ ID NO: 756 - protein, 20 aa, Artificial Sequence
  Synthetic peptide
  MOD_RES (1)..(1): N-terminal acetylation
  MOD_RES (7)..(7): beta-Leu
  MOD_RES (20)..(20): C-terminal amidation
FQSKGNLFVFGYFERLRAKL

SEQ ID NO: 757 - protein, 20 aa, Artificial Sequence
  Synthetic peptide
  MOD_RES (1)..(1): N-terminal acetylation
  MOD_RES (9)..(9): beta-Leu
  MOD_RES (20)..(20): C-terminal amidation
FQSKGNVFLFGYFERLRAKL

SEQ ID NO: 758 - protein, 20 aa, Artificial Sequence
  Synthetic peptide
  MOD_RES (1)..(1): N-terminal acetylation
  MOD_RES (11)..(11): beta-Ala
  MOD_RES (20)..(20): C-terminal amidation
FQSKGNVFVFAYFERLRAKL

SEQ ID NO: 759 - protein, 20 aa, Artificial Sequence
  Synthetic peptide
  MOD_RES (1)..(1): N-terminal acetylation
  MOD_RES (12)..(12): beta-Tyr
  MOD_RES (20)..(20): C-terminal amidation
FQSKGNVFVFGYFERLRAKL

SEQ ID NO: 760 - protein, 20 aa, Artificial Sequence
  Synthetic peptide
  MOD_RES (1)..(1): N-terminal acetylation
  MOD_RES (15)..(15): beta-Homoarginine
  MOD_RES (20)..(20): C-terminal amidation
FQSKGNVFVFGYFERLRAKL

SEQ ID NO: 761 - protein, 20 aa, Artificial Sequence
  Synthetic peptide
  MOD_RES (1)..(1): N-terminal acetylation
  MOD_RES (15)..(15): Xaa is Norleucine
  MOD_RES (20)..(20): C-terminal amidation
FQSKGNVFVFGYFEXLRAKL

SEQ ID NO: 762 - protein, 20 aa, Artificial Sequence
  Synthetic peptide
  MOD_RES (1)..(1): N-terminal acetylation
  MOD_RES (20)..(20): C-terminal amidation
FQSKKNVFGFGYFERLRAKL

SEQ ID NO: 763 - protein, 20 aa, Artificial Sequence
  Synthetic peptide
  MOD_RES (1)..(1): N-terminal acetylation
  MOD_RES (20)..(20): C-terminal amidation
FQSKKNVFVFGGFERLRAKL

SEQ ID NO: 764 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEGLRAKL

SEQ ID NO: 765 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKK

SEQ ID NO: 766 - protein, 20 aa, Artificial Sequence
  Synthetic peptide
  MOD_RES (1)..(1): N-terminal acetylation
  MOD_RES (20)..(20): C-terminal amidation
FFSKKNVFVFGYFERLRAKL

SEQ ID NO: 767 - protein, 20 aa, Artificial Sequence
  Synthetic peptide
  MOD_RES (1)..(1): N-terminal acetylation
  MOD_RES (20)..(20): C-terminal amidation
FQFKKNVFVFGYFERLRAKL

SEQ ID NO: 768 - protein, 20 aa, Artificial Sequence
  Synthetic peptide
  MOD_RES (1)..(1): N-terminal acetylation
  MOD_RES (20)..(20): C-terminal amidation
FQSFKNVFVFGYFERLRAKL

SEQ ID NO: 769 - protein, 20 aa, Artificial Sequence
  Synthetic peptide
  MOD_RES (1)..(1): N-terminal acetylation
  MOD_RES (20)..(20): C-terminal amidation
FQSKKFVFVFGYFERLRAKL

SEQ ID NO: 770 - protein, 20 aa, Artificial Sequence
  Synthetic peptide
  MOD_RES (1)..(1): N-terminal acetylation
  MOD_RES (20)..(20): C-terminal amidation
FQSKKNVFVFFYFERLRAKL

SEQ ID NO: 771 - protein, 20 aa, Artificial Sequence
  Synthetic peptide
  MOD_RES (1)..(1): N-terminal acetylation
  MOD_RES (20)..(20): C-terminal amidation
FQSKKNVFVFGFFERLRAKL

SEQ ID NO: 772 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEFLRAKL

SEQ ID NO: 773 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERFRAKL

SEQ ID NO: 774 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLFAKL

SEQ ID NO: 775 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAFL

SEQ ID NO: 776 - protein, 20 aa, Artificial Sequence
  Synthetic peptide
  MOD_RES (1)..(1): N-terminal acetylation
  MOD_RES (20)..(20): C-terminal amidation
FDSKKNVFVFGYFERLRAKL

SEQ ID NO: 777 - protein, 20 aa, Artificial Sequence
  Synthetic peptide
  MOD_RES (1)..(1): N-terminal acetylation
  MOD_RES (20)..(20): C-terminal amidation
FQSDKNVFVFGYFERLRAKL

SEQ ID NO: 778 - protein, 20 aa, Artificial Sequence
  Synthetic peptide
  MOD_RES (1)..(1): N-terminal acetylation
  MOD_RES (20)..(20): C-terminal amidation
FQSKKNDFVFGYFERLRAKL

SEQ ID NO: 779 - protein, 20 aa, Artificial Sequence
  Synthetic peptide
  MOD_RES (1)..(1): N-terminal acetylation
  MOD_RES (20)..(20): C-terminal amidation
FQSKKNVDVFGYFERLRAKL

SEQ ID NO: 780 - protein, 20 aa, Artificial Sequence
  Synthetic peptide
  MOD_RES (1)..(1): N-terminal acetylation
  MOD_RES (20)..(20): C-terminal amidation
FQSKKNVFDFGYFERLRAKL

SEQ ID NO: 781 - protein, 20 aa, Artificial Sequence
  Synthetic peptide
  MOD_RES (1)..(1): N-terminal acetylation
  MOD_RES (20)..(20): C-terminal amidation
FQSKKNVFVFGDFERLRAKL

SEQ ID NO: 782 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERDRAKL

SEQ ID NO: 783 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLDAKL

SEQ ID NO: 784 - protein, 20 aa, Artificial Sequence
  Synthetic peptide
  MOD_RES (1)..(1): N-terminal acetylation
  MOD_RES (20)..(20): C-terminal amidation
FLSKKNVFVFGYFERLRAKL

SEQ ID NO: 785 - protein, 20 aa, Artificial Sequence
  Synthetic peptide
  MOD_RES (1)..(1): N-terminal acetylation
  MOD_RES (20)..(20): C-terminal amidation
FQLKKNVFVFGYFERLRAKL

SEQ ID NO: 786 - protein, 20 aa, Artificial Sequence
  Synthetic peptide
  MOD_RES (1)..(1): N-terminal acetylation
  MOD_RES (20)..(20): C-terminal amidation
FQSLKNVFVFGYFERLRAKL

SEQ ID NO: 787 - protein, 20 aa, Artificial Sequence
  Synthetic peptide
  MOD_RES (1)..(1): N-terminal acetylation
  MOD_RES (20)..(20): C-terminal amidation
FQSKLNVFVFGYFERLRAKL

SEQ ID NO: 788 - protein, 20 aa, Artificial Sequence
  Synthetic peptide
  MOD_RES (1)..(1): N-terminal acetylation
  MOD_RES (20)..(20): C-terminal amidation
FQSKKLVFVFGYFERLRAKL

SEQ ID NO: 789 - protein, 20 aa, Artificial Sequence
  Synthetic peptide
  MOD_RES (1)..(1): N-terminal acetylation
  MOD_RES (20)..(20): C-terminal amidation
FQSKKNVFLFGYFERLRAKL

SEQ ID NO: 790 - protein, 20 aa, Artificial Sequence
  Synthetic peptide
  MOD_RES (1)..(1): N-terminal acetylation
  MOD_RES (20)..(20): C-terminal amidation
FQSKKNVFVFLYFERLRAKL

SEQ ID NO: 791 - protein, 20 aa, Artificial Sequence
  Synthetic peptide
  MOD_RES (1)..(1): N-terminal acetylation
  MOD_RES (20)..(20): C-terminal amidation
FQSKKNVFVFGLFERLRAKL

SEQ ID NO: 792 - protein, 20 aa, Artificial Sequence
  Synthetic peptide
  MOD_RES (1)..(1): N-terminal acetylation
  MOD_RES (20)..(20): C-terminal amidation
FQSKKNVAVFGYFERLRAKL

SEQ ID NO: 793 - protein, 20 aa, Artificial Sequence
  Synthetic peptide
  MOD_RES (1)..(1): N-terminal acetylation
  MOD_RES (20)..(20): C-terminal amidation
FQSKKNVFVFAYFERLRAKL

SEQ ID NO: 794 - protein, 20 aa, Artificial Sequence
  Synthetic peptide
  MOD_RES (1)..(1): N-terminal acetylation
  MOD_RES (20)..(20): C-terminal amidation
FQSKKNVFVFGAFERLRAKL

SEQ ID NO: 795 - protein, 20 aa, Artificial Sequence
  Synthetic peptide
  MOD_RES (1)..(1): N-terminal acetylation
  MOD_RES (20)..(20): C-terminal amidation
FQSKKNVFVFGYAERLRAKL

SEQ ID NO: 796 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEALRAKL

SEQ ID NO: 797 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERARAKL

SEQ ID NO: 798 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAAL

SEQ ID NO: 799 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKA

SEQ ID NO: 800 - protein, 20 aa, Artificial Sequence
  Synthetic peptide
  MOD_RES (1)..(1): N-terminal acetylation
  MOD_RES (20)..(20): C-terminal amidation
PQSKKNVFVFGYFERLRAKL

SEQ ID NO: 801 - protein, 20 aa, Artificial Sequence
  Synthetic peptide
  MOD_RES (1)..(1): N-terminal acetylation
  MOD_RES (20)..(20): C-terminal amidation
FPSKKNVFVFGYFERLRAKL

SEQ ID NO: 802 - protein, 20 aa, Artificial Sequence
  Synthetic peptide
  MOD_RES (1)..(1): N-terminal acetylation
  MOD_RES (20)..(20): C-terminal amidation
FQSKKNVPVFGYFERLRAKL

SEQ ID NO: 803 - protein, 20 aa, Artificial Sequence
  Synthetic peptide
  MOD_RES (1)..(1): N-terminal acetylation
  MOD_RES (20)..(20): C-terminal amidation
FQSKKNVFVFPYFERLRAKL

SEQ ID NO: 804 - protein, 20 aa, Artificial Sequence
  Synthetic peptide
  MOD_RES (1)..(1): N-terminal acetylation
  MOD_RES (20)..(20): C-terminal amidation
FQSKKNVFVFGPFERLRAKL

SEQ ID NO: 805 - protein, 20 aa, Artificial Sequence
  Synthetic peptide
  MOD_RES (1)..(1): N-terminal acetylation
  MOD_RES (20)..(20): C-terminal amidation
FQSKKNVFVFGYPERLRAKL

SEQ ID NO: 806 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEPLRAKL

SEQ ID NO: 807 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLPAKL

SEQ ID NO: 808 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRPKL

SEQ ID NO: 809 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAPL

SEQ ID NO: 810 - protein, 20 aa, Artificial Sequence
  Synthetic peptide
  MOD_RES (1)..(1): N-terminal acetylation
  MOD_RES (20)..(20): C-terminal amidation
SQSKKNVFVFGYFERLRAKL

SEQ ID NO: 811 - protein, 20 aa, Artificial Sequence
  Synthetic peptide
  MOD_RES (1)..(1): N-terminal acetylation
  MOD_RES (20)..(20): C-terminal amidation
FQSKSNVFVFGYFERLRAKL

SEQ ID NO: 812 - protein, 20 aa, Artificial Sequence
  Synthetic peptide
  MOD_RES (1)..(1): N-terminal acetylation
  MOD_RES (20)..(20): C-terminal amidation
FQSKKNVSVFGYFERLRAKL

SEQ ID NO: 813 - protein, 20 aa, Artificial Sequence
  Synthetic peptide
  MOD_RES (1)..(1): N-terminal acetylation
  MOD_RES (20)..(20): C-terminal amidation
FQSKKNVFVFGSFERLRAKL

SEQ ID NO: 814 - protein, 20 aa, Artificial Sequence
  Synthetic peptide
  MOD_RES (1)..(1): N-terminal acetylation
  MOD_RES (20)..(20): C-terminal amidation
FQSKKNVFVFGYSERLRAKL

SEQ ID NO: 815 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFESLRAKL

SEQ ID NO: 816 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERSRAKL

SEQ ID NO: 817 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLSAKL

SEQ ID NO: 818 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKS

SEQ ID NO: 819 - protein, 20 aa, Artificial Sequence
  Synthetic peptide
  MOD_RES (1)..(1): N-terminal acetylation
  MOD_RES (16)..(16): D-Leu
  MOD_RES (20)..(20): C-terminal amidation
FQSKKNVFVFGYFERLRAKL

SEQ ID NO: 820 - protein, 20 aa, Artificial Sequence
  Synthetic peptide
  MOD_RES (1)..(1): N-terminal acetylation
  MOD_RES (18)..(18): D-Ala
  MOD_RES (20)..(20): C-terminal amidation
FQSKKNVFVFGYFERLRAKL

SEQ ID NO: 821 - protein, 20 aa, Artificial Sequence
  Synthetic peptide
  MOD_RES (1)..(1): N-terminal acetylation
  MOD_RES (19)..(19): D-Lys
  MOD_RES (20)..(20): C-terminal amidation
FQSKKNVFVFGYFERLRAKL

SEQ ID NO: 822 - protein, 20 aa, Artificial Sequence
  Synthetic peptide
  MOD_RES (1)..(1): N-terminal acetylation
  MOD_RES (20)..(20): D-Leu
  MOD_RES (20)..(20): C-terminal amidation
FQSKKNVFVFGYFERLRAKL

SEQ ID NO: 823 - protein, 20 aa, Artificial Sequence
  Synthetic peptide
  MOD_RES (1)..(1): N-terminal acetylation
  MOD_RES (15)..(15): omega-methyl-Arg
  MOD_RES (17)..(17): omega-methyl-Arg
  MOD_RES (20)..(20): C-terminal amidation
FQSKKNVFVFGYFERLRAKL

SEQ ID NO: 824 - protein, 20 aa, Artificial Sequence
  Synthetic peptide
  MOD_RES (1)..(1): N-terminal acetylation
  MOD_RES (20)..(20): C-terminal amidation
FQSKGNVAVDGYFERLRAKL

SEQ ID NO: 825 - protein, 20 aa, Artificial Sequence
  Synthetic peptide
  MOD_RES (1)..(1): N-terminal acetylation
  MOD_RES (20)..(20): C-terminal amidation
FQSKGNVFVDAYFERLRAKL

SEQ ID NO: 826 - protein, 20 aa, Artificial Sequence
  Synthetic peptide
  MOD_RES (1)..(1): N-terminal acetylation
  MOD_RES (20)..(20): C-terminal amidation
FQSKGNVFVDGAFERLRAKL

SEQ ID NO: 827 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERARAKL

SEQ ID NO: 828 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAAL

SEQ ID NO: 829 - protein, 20 aa, Artificial Sequence
  Synthetic peptide
  MOD_RES (1)..(1): N-terminal acetylation
  MOD_RES (20)..(20): C-terminal amidation
DQSKGNVFVDGYFERLRAKL

SEQ ID NO: 830 - protein, 20 aa, Artificial Sequence
  Synthetic peptide
  MOD_RES (1)..(1): N-terminal acetylation
  MOD_RES (20)..(20): C-terminal amidation
FDSKGNVFVDGYFERLRAKL

SEQ ID NO: 831 - protein, 20 aa, Artificial Sequence
  Synthetic peptide
  MOD_RES (1)..(1): N-terminal acetylation
  MOD_RES (20)..(20): C-terminal amidation
FQSKGNDFVDGYFERLRAKL

SEQ ID NO: 832 - protein, 20 aa, Artificial Sequence
  Synthetic peptide
  MOD_RES (1)..(1): N-terminal acetylation
  MOD_RES (20)..(20): C-terminal amidation
FQSKGNVDVDGYFERLRAKL

SEQ ID NO: 833 - protein, 20 aa, Artificial Sequence
  Synthetic peptide
  MOD_RES (1)..(1): N-terminal acetylation
  MOD_RES (20)..(20): C-terminal amidation
FQSKGNVFDDGYFERLRAKL

SEQ ID NO: 834 - protein, 20 aa, Artificial Sequence
  Synthetic peptide
  MOD_RES (1)..(1): N-terminal acetylation
  MOD_RES (20)..(20): C-terminal amidation
FQSKGNVFVDDYFERLRAKL

SEQ ID NO: 835 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEDLRAKL

SEQ ID NO: 836 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERDRAKL

SEQ ID NO: 837 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRADL

SEQ ID NO: 838 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKD

SEQ ID NO: 839 - protein, 20 aa, Artificial Sequence
  Synthetic peptide
  MOD_RES (1)..(1): N-terminal acetylation
  MOD_RES (20)..(20): C-terminal amidation
FESKGNVFVDGYFERLRAKL

SEQ ID NO: 840 - protein, 20 aa, Artificial Sequence
  Synthetic peptide
  MOD_RES (1)..(1): N-terminal acetylation
  MOD_RES (20)..(20): C-terminal amidation
FQSKGNVEVDGYFERLRAKL

SEQ ID NO: 841 - protein, 20 aa, Artificial Sequence
  Synthetic peptide
  MOD_RES (1)..(1): N-terminal acetylation
  MOD_RES (20)..(20): C-terminal amidation
FQSKGNVFEDGYFERLRAKL

SEQ ID NO: 842 - protein, 20 aa, Artificial Sequence
  Synthetic peptide
  MOD_RES (1)..(1): N-terminal acetylation
  MOD_RES (20)..(20): C-terminal amidation
FQSKGNVFVDEYFERLRAKL

SEQ ID NO: 843 - protein, 20 aa, Artificial Sequence
  Synthetic peptide
  MOD_RES (1)..(1): N-terminal acetylation
  MOD_RES (20)..(20): C-terminal amidation
FQSKGNVFVDGEFERLRAKL

SEQ ID NO: 844 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERERAKL

SEQ ID NO: 845 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAEL

SEQ ID NO: 846 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKE

SEQ ID NO: 847 - protein, 20 aa, Artificial Sequence
  Synthetic peptide
  MOD_RES (1)..(1): N-terminal acetylation
  MOD_RES (20)..(20): C-terminal amidation
FQSKGNVFVDFYFERLRAKL

SEQ ID NO: 848 - protein, 20 aa, Artificial Sequence
  Synthetic peptide
  MOD_RES (1)..(1): N-terminal acetylation
  MOD_RES (20)..(20): C-terminal amidation
FQSKGNVFVDGFFERLRAKL

SEQ ID NO: 849 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERFRAKL

SEQ ID NO: 850 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAFL

SEQ ID NO: 851 - protein, 20 aa, Artificial Sequence
  Synthetic peptide
  MOD_RES (1)..(1): N-terminal acetylation
  MOD_RES (20)..(20): C-terminal amidation
GQSKGNVFVDGYFERLRAKL

SEQ ID NO: 852 - protein, 20 aa, Artificial Sequence
  Synthetic peptide
  MOD_RES (1)..(1): N-terminal acetylation
  MOD_RES (20)..(20): C-terminal amidation
FQSKGNGFVDGYFERLRAKL

SEQ ID NO: 853 - protein, 20 aa, Artificial Sequence
  Synthetic peptide
  MOD_RES (1)..(1): N-terminal acetylation
  MOD_RES (20)..(20): C-terminal amidation
FQSKGNVGVDGYFERLRAKL

SEQ ID NO: 854 - protein, 20 aa, Artificial Sequence
  Synthetic peptide
  MOD_RES (1)..(1): N-terminal acetylation
  MOD_RES (20)..(20): C-terminal amidation
FQSKGNVFGDGYFERLRAKL

SEQ ID NO: 855 - protein, 20 aa, Artificial Sequence
  Synthetic peptide
  MOD_RES (1)..(1): N-terminal acetylation
  MOD_RES (20)..(20): C-terminal amidation
FQSKGNVFVDGGFERLRAKL

SEQ ID NO: 856 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERGRAKL

SEQ ID NO: 857 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAGL

SEQ ID NO: 858 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKG

SEQ ID NO: 859 - protein, 20 aa, Artificial Sequence
  Synthetic peptide
  MOD_RES (1)..(1): N-terminal acetylation
  MOD_RES (20)..(20): C-terminal amidation
FHSKGNVFVDGYFERLRAKL

SEQ ID NO: 860 - protein, 20 aa, Artificial Sequence
  Synthetic peptide
  MOD_RES (1)..(1): N-terminal acetylation
  MOD_RES (20)..(20): C-terminal amidation
FQSKGNVFHDGYFERLRAKL

SEQ ID NO: 861 - protein, 20 aa, Artificial Sequence
  Synthetic peptide
  MOD_RES (1)..(1): N-terminal acetylation
  MOD_RES (20)..(20): C-terminal amidation
FQSKGNVFVDGHFERLRAKL

SEQ ID NO: 862 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEHLRAKL

SEQ ID NO: 863 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERHRAKL

SEQ ID NO: 864 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAHL

SEQ ID NO: 865 - protein, 20 aa, Artificial Sequence
  Synthetic peptide
  MOD_RES (1)..(1): N-terminal acetylation
  MOD_RES (20)..(20): C-terminal amidation
FQSKGNVIVDGYFERLRAKL

SEQ ID NO: 866 - protein, 20 aa, Artificial Sequence
  Synthetic peptide
  MOD_RES (1)..(1): N-terminal acetylation
  MOD_RES (20)..(20): C-terminal amidation
FQSKGNVFVDIYFERLRAKL

SEQ ID NO: 867 - protein, 20 aa, Artificial Sequence
  Synthetic peptide
  MOD_RES (1)..(1): N-terminal acetylation
  MOD_RES (20)..(20): C-terminal amidation
FQSKGNVFVDGIFERLRAKL

SEQ ID NO: 868 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEILRAKL

SEQ ID NO: 869 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERIRAKL

SEQ ID NO: 870 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAIL

SEQ ID NO: 871 - protein, 20 aa, Artificial Sequence
  Synthetic peptide
  MOD_RES (1)..(1): N-terminal acetylation
  MOD_RES (20)..(20): C-terminal amidation
FKSKGNVFVDGYFERLRAKL

SEQ ID NO: 872 - protein, 20 aa, Artificial Sequence
  Synthetic peptide
  MOD_RES (1)..(1): N-terminal acetylation
  MOD_RES (20)..(20): C-terminal amidation
FQSKGNKFVDGYFERLRAKL

SEQ ID NO: 873 - protein, 20 aa, Artificial Sequence
  Synthetic peptide
  MOD_RES (1)..(1): N-terminal acetylation
  MOD_RES (20)..(20): C-terminal amidation
FQSKGNVKVDGYFERLRAKL

SEQ ID NO: 874 - protein, 20 aa, Artificial Sequence
  Synthetic peptide
  MOD_RES (1)..(1): N-terminal acetylation
  MOD_RES (20)..(20): C-terminal amidation
FQSKGNVFVDKYFERLRAKL

SEQ ID NO: 875 - protein, 20 aa, Artificial Sequence
  Synthetic peptide
  MOD_RES (1)..(1): N-terminal acetylation
  MOD_RES (20)..(20): C-terminal amidation
FQSKGNVFVDGKFERLRAKL

SEQ ID NO: 876 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEKLRAKL

SEQ ID NO: 877 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERKRAKL

SEQ ID NO: 878 - protein, 20 aa, Artificial Sequence
  Synthetic peptide
  MOD_RES (1)..(1): N-terminal acetylation
  MOD_RES (20)..(20): C-terminal amidation
FLSKGNVFVDGYFERLRAKL

SEQ ID NO: 879 - protein, 20 aa, Artificial Sequence
  Synthetic peptide
  MOD_RES (1)..(1): N-terminal acetylation
  MOD_RES (20)..(20): C-terminal amidation
FQSKGNVLVDGYFERLRAKL

SEQ ID NO: 880 - protein, 20 aa, Artificial Sequence
  Synthetic peptide
  MOD_RES (1)..(1): N-terminal acetylation
  MOD_RES (20)..(20): C-terminal amidation
FQSKGNVFLDGYFERLRAKL

SEQ ID NO: 881 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRALL

SEQ ID NO: 882 - protein, 20 aa, Artificial Sequence
  Synthetic peptide
  MOD_RES (1)..(1): N-terminal acetylation
  MOD_RES (20)..(20): C-terminal amidation
FQSKGNMFVDGYFERLRAKL

SEQ ID NO: 883 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERMRAKL

SEQ ID NO: 884 - protein, 20 aa, Artificial Sequence
  Synthetic peptide
  MOD_RES (1)..(1): N-terminal acetylation
  MOD_RES (20)..(20): C-terminal amidation
FQSKGNNFVDGYFERLRAKL

SEQ ID NO: 885 - protein, 20 aa, Artificial Sequence
  Synthetic peptide
  MOD_RES (1)..(1): N-terminal acetylation
  MOD_RES (20)..(20): C-terminal amidation
FQSKGNVNVDGYFERLRAKL

SEQ ID NO: 886 - protein, 20 aa, Artificial Sequence
  Synthetic peptide
  MOD_RES (1)..(1): N-terminal acetylation
  MOD_RES (20)..(20): C-terminal amidation
FQSKGNVFNDGYFERLRAKL

SEQ ID NO: 887 - protein, 20 aa, Artificial Sequence
  Synthetic peptide
  MOD_RES (1)..(1): N-terminal acetylation
  MOD_RES (20)..(20): C-terminal amidation
FQSKGNVFVDNYFERLRAKL

SEQ ID NO: 888 - protein, 20 aa, Artificial Sequence
  Synthetic peptide
  MOD_RES (1)..(1): N-terminal acetylation
  MOD_RES (20)..(20): C-terminal amidation
FQSKGNVFVDGNFERLRAKL

SEQ ID NO: 889 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERNRAKL

SEQ ID NO: 890 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRANL

SEQ ID NO: 891 - protein, 20 aa, Artificial Sequence
  Synthetic peptide
  MOD_RES (1)..(1): N-terminal acetylation
  MOD_RES (20)..(20): C-terminal amidation
PQSKGNVFVDGYFERLRAKL

SEQ ID NO: 892 - protein, 20 aa, Artificial Sequence
  Synthetic peptide
  MOD_RES (1)..(1): N-terminal acetylation
  MOD_RES (20)..(20): C-terminal amidation
FPSKGNVFVDGYFERLRAKL

SEQ ID NO: 893 - protein, 20 aa, Artificial Sequence
  Synthetic peptide
  MOD_RES (1)..(1): N-terminal acetylation
  MOD_RES (20)..(20): C-terminal amidation
FQPKGNVFVDGYFERLRAKL

SEQ ID NO: 894 - protein, 20 aa, Artificial Sequence
  Synthetic peptide
  MOD_RES (1)..(1): N-terminal acetylation
  MOD_RES (20)..(20): C-terminal amidation
FQSKGPVFVDGYFERLRAKL

SEQ ID NO: 895 - protein, 20 aa, Artificial Sequence
  Synthetic peptide
  MOD_RES (1)..(1): N-terminal acetylation
  MOD_RES (20)..(20): C-terminal amidation
FQSKGNVPVDGYFERLRAKL

SEQ ID NO: 896 - protein, 20 aa, Artificial Sequence
  Synthetic peptide
  MOD_RES (1)..(1): N-terminal acetylation
  MOD_RES (20)..(20): C-terminal amidation
FQSKGNVFPDGYFERLRAKL

SEQ ID NO: 897 - protein, 20 aa, Artificial Sequence
  Synthetic peptide
  MOD_RES (1)..(1): N-terminal acetylation
  MOD_RES (20)..(20): C-terminal amidation
FQSKGNVFVDGPFERLRAKL

SEQ ID NO: 898 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERPRAKL

SEQ ID NO: 899 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLPAKL

SEQ ID NO: 900 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRPKL

SEQ ID NO: 901 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAPL

SEQ ID NO: 902 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKP

SEQ ID NO: 903 - protein, 20 aa, Artificial Sequence
  Synthetic peptide
  MOD_RES (1)..(1): N-terminal acetylation
  MOD_RES (20)..(20): C-terminal amidation
FQSKGNVQVDGYFERLRAKL

SEQ ID NO: 904 - protein, 20 aa, Artificial Sequence
  Synthetic peptide
  MOD_RES (1)..(1): N-terminal acetylation
  MOD_RES (20)..(20): C-terminal amidation
FQSKGNVFVDGQFERLRAKL

SEQ ID NO: 905 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERQRAKL

SEQ ID NO: 906 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAQL

SEQ ID NO: 907 - protein, 20 aa, Artificial Sequence
  Synthetic peptide
  MOD_RES (1)..(1): N-terminal acetylation
  MOD_RES (20)..(20): C-terminal amidation
FQSKGNVFVDRYFERLRAKL

SEQ ID NO: 908 - protein, 20 aa, Artificial Sequence
  Synthetic peptide
  MOD_RES (1)..(1): N-terminal acetylation
  MOD_RES (20)..(20): C-terminal amidation
FQSKGNVFVDGRFERLRAKL

SEQ ID NO: 909 - protein, 20 aa, Artificial Sequence
  Synthetic peptide
  MOD_RES (1)..(1): N-terminal acetylation
  MOD_RES (20)..(20): C-terminal amidation
FQSKGNVSVDGYFERLRAKL

SEQ ID NO: 910 - protein, 20 aa, Artificial Sequence
  Synthetic peptide
  MOD_RES (1)..(1): N-terminal acetylation
  MOD_RES (20)..(20): C-terminal amidation
FQSKGNVFVDGSFERLRAKL

SEQ ID NO: 911 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFESLRAKL

SEQ ID NO: 912 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERSRAKL

SEQ ID NO: 913 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRASL

SEQ ID NO: 914 - protein, 20 aa, Artificial Sequence
  Synthetic peptide
  MOD_RES (1)..(1): N-terminal acetylation
  MOD_RES (20)..(20): C-terminal amidation
FTSKGNVFVDGYFERLRAKL

SEQ ID NO: 915 - protein, 20 aa, Artificial Sequence
  Synthetic peptide
  MOD_RES (1)..(1): N-terminal acetylation
  MOD_RES (20)..(20): C-terminal amidation
FQSKGNVTVDGYFERLRAKL

SEQ ID NO: 916 - protein, 20 aa, Artificial Sequence
  Synthetic peptide
  MOD_RES (1)..(1): N-terminal acetylation
  MOD_RES (20)..(20): C-terminal amidation
FQSKGNVFVDTYFERLRAKL

SEQ ID NO: 917 - protein, 20 aa, Artificial Sequence
  Synthetic peptide
  MOD_RES (1)..(1): N-terminal acetylation
  MOD_RES (20)..(20): C-terminal amidation
FQSKGNVFVDGTFERLRAKL

SEQ ID NO: 918 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFETLRAKL

SEQ ID NO: 919 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERTRAKL

SEQ ID NO: 920 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRATL

SEQ ID NO: 921 - protein, 20 aa, Artificial Sequence
  Synthetic peptide
  MOD_RES (1)..(1): N-terminal acetylation
  MOD_RES (20)..(20): C-terminal amidation
FVSKGNVFVDGYFERLRAKL

SEQ ID NO: 922 - protein, 20 aa, Artificial Sequence
  Synthetic peptide
  MOD_RES (1)..(1): N-terminal acetylation
  MOD_RES (20)..(20): C-terminal amidation
FQSKGNVVVDGYFERLRAKL

SEQ ID NO: 923 - protein, 20 aa, Artificial Sequence
  Synthetic peptide
  MOD_RES (1)..(1): N-terminal acetylation
  MOD_RES (20)..(20): C-terminal amidation
FQSKGNVFVDVYFERLRAKL

SEQ ID NO: 924 - protein, 20 aa, Artificial Sequence
  Synthetic peptide
  MOD_RES (1)..(1): N-terminal acetylation
  MOD_RES (20)..(20): C-terminal amidation
FQSKGNVFVDGVFERLRAKL

SEQ ID NO: 925 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEVLRAKL

SEQ ID NO: 926 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAVL

SEQ ID NO: 927 - protein, 20 aa, Artificial Sequence
  Synthetic peptide
  MOD_RES (1)..(1): N-terminal acetylation
  MOD_RES (20)..(20): C-terminal amidation
FWSKGNVFVDGYFERLRAKL

SEQ ID NO: 928 - protein, 20 aa, Artificial Sequence
  Synthetic peptide
  MOD_RES (1)..(1): N-terminal acetylation
  MOD_RES (20)..(20): C-terminal amidation
FQSKGNVFVDGWFERLRAKL

SEQ ID NO: 929 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEWLRAKL

SEQ ID NO: 930 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAWL

SEQ ID NO: 931 - protein, 20 aa, Artificial Sequence
  Synthetic peptide
  MOD_RES (1)..(1): N-terminal acetylation
  MOD_RES (20)..(20): C-terminal amidation
FYSKGNVFVDGYFERLRAKL

SEQ ID NO: 932 - protein, 20 aa, Artificial Sequence
  Synthetic peptide
  MOD_RES (1)..(1): N-terminal acetylation
  MOD_RES (20)..(20): C-terminal amidation
FQSKGNVFVDYYFERLRAKL

SEQ ID NO: 933 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEYLRAKL

SEQ ID NO: 934 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERYRAKL

SEQ ID NO: 935 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAYL

SEQ ID NO: 936 - protein, 20 aa, Artificial Sequence
  Synthetic peptide
  MOD_RES (1)..(1): N-terminal acetylation
  MOD_RES (9)..(9): D-Val
  MOD_RES (20)..(20): C-terminal amidation
FQSKGNVFVFGYFERLRAKL

SEQ ID NO: 937 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKD

SEQ ID NO: 938 - protein, 20 aa, Artificial Sequence
  Synthetic peptide
  MOD_RES (1)..(1): N-terminal acetylation
  MOD_RES (20)..(20): C-terminal amidation
LQSKTNVFVDGYFERLAAKL

SEQ ID NO: 939 - protein, 20 aa, Artificial Sequence
  Synthetic peptide
  MOD_RES (1)..(1): N-terminal acetylation
  MOD_RES (20)..(20): C-terminal amidation
FQSKFNVFVDGYTERLAAKL

SEQ ID NO: 940 - protein, 20 aa, Artificial Sequence
  Synthetic peptide
  MOD_RES (1)..(1): N-terminal acetylation
  MOD_RES (20)..(20): C-terminal amidation
FQSKHNVFVDGHFERLAAKL

SEQ ID NO: 941 - protein, 20 aa, Artificial Sequence
  Synthetic peptide
  MOD_RES (1)..(1): N-terminal acetylation
  MOD_RES (20)..(20): C-terminal amidation
FQSVHNVFVDGYFERPAAKL

SEQ ID NO: 942 - protein, 20 aa, Artificial Sequence
  Synthetic peptide
  MOD_RES (1)..(1): N-terminal acetylation
  MOD_RES (20)..(20): C-terminal amidation
FQSKYNVFVDEYFERLAAKL

SEQ ID NO: 943 - protein, 20 aa, Artificial Sequence
  Synthetic peptide
  MOD_RES (1)..(1): N-terminal acetylation
  MOD_RES (20)..(20): C-terminal amidation
FQSKPNVFVDGYFERLAAKL

SEQ ID NO: 944 - protein, 20 aa, Artificial Sequence
  Synthetic peptide
  MOD_RES (1)..(1): N-terminal acetylation
  MOD_RES (20)..(20): C-terminal amidation
HQQFKNVFVDGYFERLAAKL

SEQ ID NO: 945 - protein, 20 aa, Artificial Sequence
  Synthetic peptide
  MOD_RES (1)..(1): N-terminal acetylation
  MOD_RES (20)..(20): C-terminal amidation
FQSKHNVFVDAYFERLRAKL

SEQ ID NO: 946 - protein, 20 aa, Artificial Sequence
  Synthetic peptide
  MOD_RES (1)..(1): N-terminal acetylation
  MOD_RES (20)..(20): C-terminal amidation
FQSKKNVFVDGYSERLRAKL

SEQ ID NO: 947 - protein, 20 aa, Artificial Sequence
  Synthetic peptide
  MOD_RES (1)..(1): N-terminal acetylation
  MOD_RES (20)..(20): C-terminal amidation
FQSKGNVCVDGYFERLRAKL

SEQ ID NO: 948 - protein, 20 aa, Artificial Sequence
  Synthetic peptide
  MOD_RES (1)..(1): N-terminal acetylation
  MOD_RES (20)..(20): C-terminal amidation
FQSKGNVFCDGYFERLRAKL

SEQ ID NO: 949 - protein, 20 aa, Artificial Sequence
  Synthetic peptide
  MOD_RES (1)..(1): N-terminal acetylation
  MOD_RES (20)..(20): C-terminal amidation
FQSKGNVFVDGCFERLRAKL

SEQ ID NO: 950 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFECLRAKL

SEQ ID NO: 951 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRACL

SEQ ID NO: 952 - protein, 20 aa, Artificial Sequence
  Synthetic peptide
  MOD_RES (1)..(1): N-terminal acetylation
  MOD_RES (20)..(20): C-terminal amidation
FQSCKNVFVDGYFERLCAKL

SEQ ID NO: 953 - protein, 20 aa, Artificial Sequence
  Synthetic peptide
  MOD_RES (1)..(1): N-terminal acetylation
  MOD_RES (20)..(20): C-terminal amidation
FQSAYNVFVDGYFERLCAKL

SEQ ID NO: 954 - protein, 20 aa, Artificial Sequence
  Synthetic peptide
  MOD_RES (1)..(1): N-terminal acetylation
  MOD_RES (20)..(20): C-terminal amidation
FQSVHNVFVDGYFERPCAKL

SEQ ID NO: 955 - protein, 20 aa, Artificial Sequence
  Synthetic peptide
  MOD_RES (1)..(1): N-terminal acetylation
  MOD_RES (20)..(20): C-terminal amidation
FQSKYNVFVDEYFERLCAKL

SEQ ID NO: 956 - protein, 20 aa, Artificial Sequence
  Synthetic peptide
  MOD_RES (1)..(1): N-terminal acetylation
  MOD_RES (8)..(8): Xaa is 2-Amino-isobutyric acid
  MOD_RES (17)..(17): Xaa is 2-Amino-isobutyric acid
  MOD_RES (20)..(20): C-terminal amidation
FQSKGNVXVDGYFERLXAKL

SEQ ID NO: 957 - protein, 20 aa, Artificial Sequence
  Synthetic peptide
  MOD_RES (1)..(1): N-terminal acetylation
  MOD_RES (12)..(12): Xaa is 2-Amino-isobutyric acid
  MOD_RES (17)..(17): Xaa is 2-Amino-isobutyric acid
  MOD_RES (20)..(20): C-terminal amidation
FQSKGNVFVDGXFERLXAKL

SEQ ID NO: 958 - protein, 20 aa, Artificial Sequence
  Synthetic peptide
  MOD_RES (1)..(1): N-terminal acetylation
  MOD_RES (15)..(15): Xaa is 2-Amino-isobutyric acid
  MOD_RES (17)..(17): Xaa is 2-Amino-isobutyric acid
  MOD_RES (20)..(20): C-terminal amidation
FQSKGNVFVDGYFEXLXAKL

SEQ ID NO: 959 - protein, 20 aa, Artificial Sequence
  Synthetic peptide
  MOD_RES (1)..(1): N-terminal acetylation
  MOD_RES (17)..(17): Xaa is 2-Amino-isobutyric acid
  MOD_RES (19)..(19): Xaa is 2-Amino-isobutyric acid
  MOD_RES (20)..(20): C-terminal amidation
FQSKGNVFVDGYFERLXAXL

SEQ ID NO: 960 - protein, 11 aa, Artificial Sequence
  Synthetic peptide
  MOD_RES (1)..(1): N-terminal acetylation
  MOD_RES (11)..(11): C-terminal amidation
DGYFERLRAKL

SEQ ID NO: 961 - protein, 7 aa, Artificial Sequence
  Synthetic peptide
  MOD_RES (1)..(1): N-terminal acetylation
  MOD_RES (7)..(7): C-terminal amidation
FQSKKNV

SEQ ID NO: 962 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGVGRLQVAFQSKKNVFVFGYFERLRAKLTS

SEQ ID NO: 963 - protein, 33 aa, Artificial Sequence
  Synthetic peptide
  MOD_RES (1)..(1): N-terminal acetylation
  MOD_RES (32)..(32): Xaa is (13-Amino-4,7,10-trioxa-tridecayl)-succinamic acid
  MOD_RES (33)..(33): Xaa is Lysin(biotin)
  MOD_RES (33)..(33): C-terminal amidation
SGVGRLQVAFQSKKNVFVFGYFERLRAKLTSXX

SEQ ID NO: 964 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XAFQSKKNVFVFGYFERLRAK

SEQ ID NO: 965 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKKNVFVFGYFERLRAKL

SEQ ID NO: 966 - protein, 22 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (2)..(2): Xaa is (13-Amino-4,7,10-trioxa-tridecayl)-succinamic acid
  MOD_RES (22)..(22): C-terminal amidation
XXQSKKNVFVFGYFERLRAKLT

SEQ ID NO: 967 - protein, 19 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (19)..(19): C-terminal amidation
XQSKKNVFVFGYFERLRAK

SEQ ID NO: 968 - protein, 25 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (25)..(25): C-terminal amidation
XKKFQSKKNVFVFGYFERLRAKLKK

SEQ ID NO: 969 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XGKNAKFYLFESLRQVKFVFR

SEQ ID NO: 970 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XYKFSFNKELFKQARLRFVGV

SEQ ID NO: 971 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XSGVGRLQVAFQSKKNVFVFG

SEQ ID NO: 972 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKKNVFVDGYFERLRAKL

SEQ ID NO: 973 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKNNVFVFGYFERLRAKL

SEQ ID NO: 974 - protein, 21 aa, Artificial Sequence
  Synthetic peptide
  MOD_RES (1)..(1): C-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKKNVFVFGYFDRLRAKL

SEQ ID NO: 975 - protein, 20 aa, Artificial Sequence
  Synthetic peptide
  MOD_RES (1)..(1): N-terminal Biotinyl
  MOD_RES (20)..(20): C-terminal amidation
FQSKKNVFVFGYFERLRAKL

SEQ ID NO: 976 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFDRLRAKL

SEQ ID NO: 977 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKGNVFVDGYFERLRAKL

SEQ ID NO: 978 - protein, 20 aa, Artificial Sequence
  Synthetic peptide
  MOD_RES (1)..(1): N-terminal acetylation
  MOD_RES (20)..(20): C-terminal N-propyl
FQSKGNVFVFGYFERLRAKL

SEQ ID NO: 979-1000 - skipped (22 entries)

SEQ ID NO: 1001 - protein, 35 aa, Artificial Sequence
  Synthetic peptide
  MOD_RES (1)..(1): N-terminal acetylation
  DISULFID (12)..(23): Cys residues linked via disulfide bond
  MOD_RES (35)..(35): C-terminal amidation
KKSGASRYKWFCGMRDMKGTMSCVWVKFRYDTSKK

SEQ ID NO: 1002 - protein, 28 aa, Artificial Sequence
  Synthetic peptide
  MOD_RES (1)..(1): N-terminal acetylation
  DISULFID (10)..(21): Cys residues linked via disulfide bond
  MOD_RES (28)..(28): C-terminal amidation
SGASRYKWFCGMRDMKGTMSCVWVKFRY

SEQ ID NO: 1003 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKF

SEQ ID NO: 1004 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCAMRDMKGTMSCVWVKF

SEQ ID NO: 1005 - protein, 23 aa, Artificial Sequence
  Synthetic peptide
  MOD_RES (1)..(1): N-terminal amidation
  DISULFID (7)..(18): Cys residues linked via disulfide bond
  MOD_RES (23)..(23): C-terminal amidation
SRYKWFCAMRDMKGTMSCVWVKF

SEQ ID NO: 1006 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMPDMKGTMSCVWVKF

SEQ ID NO: 1007 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
DRYKWFCGMRDMKGTMSCVWVKF

SEQ ID NO: 1008 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMDGTMSCVWVKF

SEQ ID NO: 1009 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKD

SEQ ID NO: 1010 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SFYKWFCGMRDMKGTMSCVWVKF

SEQ ID NO: 1011 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRFKWFCGMRDMKGTMSCVWVKF

SEQ ID NO: 1012 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDFKGTMSCVWVKF

SEQ ID NO: 1013 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTFSCVWVKF

SEQ ID NO: 1014 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
GRYKWFCGMRDMKGTMSCVWVKF

SEQ ID NO: 1015 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMGGTMSCVWVKF

SEQ ID NO: 1016 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
KRYKWFCGMRDMKGTMSCVWVKF

SEQ ID NO: 1017 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMKDMKGTMSCVWVKF

SEQ ID NO: 1018 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
LRYKWFCGMRDMKGTMSCVWVKF

SEQ ID NO: 1019 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDLKGTMSCVWVKF

SEQ ID NO: 1020 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKL

SEQ ID NO: 1021 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCSMRDMKGTMSCVWVKF

SEQ ID NO: 1022 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMSGTMSCVWVKF

SEQ ID NO: 1023 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVPF

SEQ ID NO: 1024 - protein, 23 aa, Artificial Sequence
  Synthetic peptide
  DISULFID (7)..(18): Cys residues linked via disulfide bond
  MOD_RES (23)..(23): C-terminal amidation
SRYKWFCGMRDMKGTMSCVWVKF

SEQ ID NO: 1025 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Leu
  MOD_RES (23)..(23): C-terminal amidation
SRYKWFCGMRDLKGTMSCVWVKF

SEQ ID NO: 1026 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SMYKWHCGMRDMKGTYSCVWVKF

SEQ ID NO: 1027 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
FHYKWHCGMRDMKGTYSCVWVKF

SEQ ID NO: 1028 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIMSCAWVKF

SEQ ID NO: 1029 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIMSCVWVKY

SEQ ID NO: 1030 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIDSCVWVRF

SEQ ID NO: 1031 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIMSCVWVKA

SEQ ID NO: 1032 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTMTCVWVKF

SEQ ID NO: 1033 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTMSCVWVKS

SEQ ID NO: 1034 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SHYKWHCAMRDMKGTYSCVWVKF

SEQ ID NO: 1035 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGVRDMKGTMSCVWVKS

SEQ ID NO: 1036 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
GHYKWHCGMRDMKGTFSCVWVF

SEQ ID NO: 1037 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
AYYKWHCGMRDLKGTMSCVWVKS

SEQ ID NO: 1038 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTYSCVWVKM

SEQ ID NO: 1039 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SHYKWHCGMRDMKGIMSCVWVF

SEQ ID NO: 1040 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
FYYKWHCGMRDMKGTMSCAWVKF

SEQ ID NO: 1041 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTDSCVWVWY

SEQ ID NO: 1042 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SHYKWHCGMRDMKGTMSCAWVKF

SEQ ID NO: 1043 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
HYYKWHCGMRDMKGTMSCVWVKS

SEQ ID NO: 1044 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCAMRDMKGTMTCVWVKF

SEQ ID NO: 1045 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTMSCVWVLF

SEQ ID NO: 1046 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SHYKWHCAMRDMKGTMSCAWVKF

SEQ ID NO: 1047 - protein, 31 aa, Artificial Sequence
  Synthetic peptide
  MOD_RES (1)..(1): N-terminal acetylation
  DISULFID (10)..(22): Cys residues linked via disulfide bond
  MOD_RES (31)..(31): C-terminal amidation
SGASRYKWFCGMRDMKGTMSCVWVKFRYDTS

SEQ ID NO: 1048 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
ARYKWFCGMRDMKGTMSCVWVKF

SEQ ID NO: 1049 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCAWVKF

SEQ ID NO: 1050 - protein, 22 aa, Artificial Sequence
  Synthetic peptide
  MOD_RES (1)..(1): N-terminal acetylation
  DISULFID (6)..(17): Cys residues linked via disulfide bond
  MOD_RES (22)..(22): C-terminal amidation
RYKWFCGMRDMKGTMSCVWVKF

SEQ ID NO: 1051 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Met
  MOD_RES (23)..(23): C-terminal amidation
SRYKWFCGMRDMKGTMSCVWVKF

SEQ ID NO: 1052 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKDTMSCVWVKF

SEQ ID NO: 1053 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
FRYKWFCGMRDMKGTMSCVWVKF

SEQ ID NO: 1054 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMFGTMSCVWVKF

SEQ ID NO: 1055 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGGMSCVWVKF

SEQ ID NO: 1056 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SKYKWFCGMRDMKGTMSCVWVKF

SEQ ID NO: 1057 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDKKGTMSCVWVKF

SEQ ID NO: 1058 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGKMSCVWVKF

SEQ ID NO: 1059 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTKSCVWVKF

SEQ ID NO: 1060 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SLYKWFCGMRDMKGTMSCVWVKF

SEQ ID NO: 1061 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWLCGMRDMKGTMSCVWVKF

SEQ ID NO: 1062 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMLDMKGTMSCVWVKF

SEQ ID NO: 1063 - protein, 23 aa, Artificial Sequence
  Synthetic peptide
  MOD_RES (1)..(1): N-terminal acetylation
  MOD_RES (23)..(23): C-terminal amidation
SRYKWFCGMRDMLGTMSCVWVKF

SEQ ID NO: 1064 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTLSCVWVKF

SEQ ID NO: 1065 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SSYKWFCGMRDMKGTMSCVWVKF

SEQ ID NO: 1066 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRSKWFCGMRDMKGTMSCVWVKF

SEQ ID NO: 1067 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDSKGTMSCVWVKF

SEQ ID NO: 1068 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGSMSCVWVKF

SEQ ID NO: 1069 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTSSCVWVKF

SEQ ID NO: 1070 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVSF

SEQ ID NO: 1071 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKS

SEQ ID NO: 1072 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
PRYKWFCGMRDMKGTMSCVWVKF

SEQ ID NO: 1073 - protein, 22 aa, Artificial Sequence
  Synthetic peptide
  DISULFID (6)..(17): Cys residues linked via disulfide bond
  MOD_RES (22)..(22): C-terminal amidation
RYKWFCGMRDMKGTMSCVWVKF

SEQ ID NO: 1074 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Phe
  MOD_RES (23)..(23): C-terminal amidation
SRYKWFCGMRDFKGTMSCVWVKF

SEQ ID NO: 1075 - protein, 28 aa, Artificial Sequence
  Synthetic peptide
  MOD_RES (1)..(1): N-terminal acetylation
  DISULFID (10)..(21): Cys residues linked via disulfide bond
  MOD_RES (28)..(28): C-terminal amidation
SGASRYKWFCGMRDMKGTMSCVWVKFRY

SEQ ID NO: 1076 - protein, 28 aa, Artificial Sequence
  Synthetic peptide
  MOD_RES (1)..(1): N-terminal acetylation
  DISULFID (7)..(18): Cys residues linked via disulfide bond
  MOD_RES (28)..(28): C-terminal amidation
SRYKWFCGMRDMKGTMSCVWVKFRYDTS

SEQ ID NO: 1077 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): Xaa is (S)-Norleucine
  MOD_RES (12)..(12): Xaa is (S)-Norleucine
  MOD_RES (16)..(16): Xaa is (S)-Norleucine
  MOD_RES (23)..(23): C-terminal amidation
SRYKWFCGXRDXKGTXSCVWVKF

SEQ ID NO: 1078 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SAYKWFCGMRDMKGTMSCVWVKF

SEQ ID NO: 1079 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMADMKGTMSCVWVKF

SEQ ID NO: 1080 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMAGTMSCVWVKF

SEQ ID NO: 1081 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGAMSCVWVKF

SEQ ID NO: 1082 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVAF

SEQ ID NO: 1083 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKA

SEQ ID NO: 1084 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDPKGTMSCVWVKF

SEQ ID NO: 1085 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDDKGTMSCVWVKF

SEQ ID NO: 1086 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTDSCVWVKF

SEQ ID NO: 1087 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCFWVKF

SEQ ID NO: 1088 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDGKGTMSCVWVKF

SEQ ID NO: 1089 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVGF

SEQ ID NO: 1090 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKG

SEQ ID NO: 1091 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWKCGMRDMKGTMSCVWVKF

SEQ ID NO: 1092 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGLMSCVWVKF

SEQ ID NO: 1093 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCLWVKF

SEQ ID NO: 1094 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWLKF

SEQ ID NO: 1095 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMSDMKGTMSCVWVKF

SEQ ID NO: 1096 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRSMKGTMSCVWVKF

SEQ ID NO: 1097 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCSWVKF

SEQ ID NO: 1098 - protein, 23 aa, Artificial Sequence
  Synthetic peptide
  MOD_RES (1)..(1): N-terminal acetylation
  DISULFID (7)..(18): Cys residues linked via disulfide bond
SRYKWFCGMRDMKGTMSCVWVKF

SEQ ID NO: 1099 - protein, 23 aa, Artificial Sequence
  Synthetic peptide
  DISULFID (7)..(18): Cys residues linked via disulfide bond
SRYKWFCGMRDMKGTMSCVWVKF

SEQ ID NO: 1100 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Pro
  MOD_RES (23)..(23): C-terminal amidation
SRYKWFCGPRDMKGTMSCVWVKF

SEQ ID NO: 1101 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Asp
  MOD_RES (23)..(23): C-terminal amidation
SRYKWFCGMRDDKGTMSCVWVKF

SEQ ID NO: 1102 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Lys
  MOD_RES (23)..(23): C-terminal amidation
SRYKWFCGMRDKKGTMSCVWVKF

SEQ ID NO: 1103 - protein, 25 aa, Artificial Sequence
  Synthetic peptide
  MOD_RES (1)..(1): N-terminal acetylation
  DISULFID (10)..(21): Cys residues linked via disulfide bond
  MOD_RES (25)..(25): C-terminal amidation
SGASRYKWFCGMRDMKGTMSCVWVK

SEQ ID NO: 1104 - protein, 31 aa, Artificial Sequence
  Synthetic peptide
  MOD_RES (1)..(1): N-terminal acetylation
  DISULFID (10)..(21): Cys residues linked via disulfide bond
  MOD_RES (12)..(12): Xaa is (S)-Noreleucine
  MOD_RES (15)..(15): Xaa is (S)-Noreleucine
  MOD_RES (19)..(19): Xaa is (S)-Noreleucine
  MOD_RES (31)..(31): C-terminal amidation
SGASRYKWFCGXRDXKGTXSCVWVKFRYDTS

SEQ ID NO: 1105 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRAKWFCGMRDMKGTMSCVWVKF

SEQ ID NO: 1106 - protein, 23 aa, Artificial Sequence
  Synthetic peptide
  MOD_RES (1)..(1): N-terminal acetylation
  MOD_RES (5)..(5): D-Ala
  DISULFID (7)..(18): Cys residues linked via disulfide bond
  MOD_RES (17)..(17): Xaa is Norleucine
  MOD_RES (23)..(23): C-terminal amidation
SRYAWFCGMRDMKGTMSCVWVKF

SEQ ID NO: 1107 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGARDMKGTMSCVWVKF

SEQ ID NO: 1108 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDAKGTMSCVWVKF

SEQ ID NO: 1109 - protein, 23 aa, Artificial Sequence
  Synthetic peptide
  MOD_RES (1)..(1): N-terminal acetylation
  MOD_RES (5)..(5): N-methyl-Gly
  DISULFID (7)..(18): Cys residues linked via disulfide bond
  MOD_RES (23)..(23): C-terminal amidation
SRYKWFCGMRDMKGTASCVWVKF

SEQ ID NO: 1110 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMACVWVKF

SEQ ID NO: 1111 - protein, 21 aa, Artificial Sequence
  Synthetic peptide
  MOD_RES (1)..(1): N-terminal acetylation
  DISULFID (5)..(16): Cys residues linked via disulfide bond
  MOD_RES (21)..(21): C-terminal amidation
YKWFCGMRDMKGTMSCVWVKF

SEQ ID NO: 1112 - protein, 23 aa, Artificial Sequence
  Synthetic peptide
  MOD_RES (1)..(1): N-terminal acetylation
  MOD_RES (7)..(7): Homo-Cys
  DISULFID (7)..(18): Cys residues linked via disulfide bond
  MOD_RES (23)..(23): C-terminal amidation
SRYKWFCGMRDMKGTMSCVWVKF

SEQ ID NO: 1113 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Met
  MOD_RES (23)..(23): C-terminal amidation
SRYKWFCGMRDMKGTMSCVWVKF

SEQ ID NO: 1114 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Lys
  MOD_RES (23)..(23): C-terminal amidation
SRYKWFCGMRDMKGTMSCVWVKF

SEQ ID NO: 1115 - protein, 25 aa, Artificial Sequence
  Synthetic peptide
  MOD_RES (1)..(1): N-terminal acetylation
  DISULFID (9)..(20): Cys residues linked via disulfide bond
GSSRYKWFCGMRDMKGTMSCVWVKF

SEQ ID NO: 1116 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SDYKWFCGMRDMKGTMSCVWVKF

SEQ ID NO: 1117 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYDWFCGMRDMKGTMSCVWVKF

SEQ ID NO: 1118 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGDMSCVWVKF

SEQ ID NO: 1119 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMDCVWVKF

SEQ ID NO: 1120 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVDF

SEQ ID NO: 1121 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYFWFCGMRDMKGTMSCVWVKF

SEQ ID NO: 1122 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKFTMSCVWVKF

SEQ ID NO: 1123 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGFMSCVWVKF

SEQ ID NO: 1124 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMFCVWVKF

SEQ ID NO: 1125 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVFVKF

SEQ ID NO: 1126 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SGYKWFCGMRDMKGTMSCVWVKF

SEQ ID NO: 1127 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYGWFCGMRDMKGTMSCVWVKF

SEQ ID NO: 1128 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMGDMKGTMSCVWVKF

SEQ ID NO: 1129 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRGMKGTMSCVWVKF

SEQ ID NO: 1130 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTGSCVWVKF

SEQ ID NO: 1131 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMGCVWVKF

SEQ ID NO: 1132 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRKKWFCGMRDMKGTMSCVWVKF

SEQ ID NO: 1133 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGKRDMKGTMSCVWVKF

SEQ ID NO: 1134 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKKTMSCVWVKF

SEQ ID NO: 1135 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMKCVWVKF

SEQ ID NO: 1136 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKK

SEQ ID NO: 1137 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRLKWFCGMRDMKGTMSCVWVKF

SEQ ID NO: 1138 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYLWFCGMRDMKGTMSCVWVKF

SEQ ID NO: 1139 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGLRDMKGTMSCVWVKF

SEQ ID NO: 1140 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKLTMSCVWVKF

SEQ ID NO: 1141 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMLCVWVKF

SEQ ID NO: 1142 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVLF

SEQ ID NO: 1143 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYSWFCGMRDMKGTMSCVWVKF

SEQ ID NO: 1144 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKSTMSCVWVKF

SEQ ID NO: 1145 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SPYKWFCGMRDMKGTMSCVWVKF

SEQ ID NO: 1146 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCQMRDMKGTMSCVWVKF

SEQ ID NO: 1147 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCRMRDMKGTMSCVWVKF

SEQ ID NO: 1148 - protein, 23 aa, Artificial Sequence
  Synthetic peptide
  MOD_RES (1)..(1): N-terminal acetylation
  DISULFID (5)..(16): Cys residues linked via disulfide bond
  MOD_RES (23)..(23): C-terminal amidation
SRYKWFCTMRDMKGTMSCVWVKF

SEQ ID NO: 1149 - protein, 21 aa, Artificial Sequence
  Synthetic peptide
  DISULFID (7)..(18): Cys residues linked via disulfide bond
  MOD_RES (21)..(21): C-terminal amidation
YKWFCGMRDMKGTMSCVWVKF

SEQ ID NO: 1150 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Ala
  MOD_RES (23)..(23): C-terminal amidation
SRYKWFCGARDMKGTMSCVWVKF

SEQ ID NO: 1151 - protein, 23 aa, Artificial Sequence
  Synthetic peptide
  MOD_RES (1)..(1): N-terminal acetylation
  MOD_RES (12)..(12): D-Ala
  MOD_RES (23)..(23): C-terminal amidation
SRYKWFCGMRDAKGTMSCVWVKF

SEQ ID NO: 1152 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Ser
  MOD_RES (23)..(23): C-terminal amidation
SRYKWFCGMRDSKGTMSCVWVKF

SEQ ID NO: 1153 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Asp
  MOD_RES (23)..(23): C-terminal amidation
SRYKWFCGMRDMDGTMSCVWVKF

SEQ ID NO: 1154 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Ser
  MOD_RES (23)..(23): C-terminal amidation
SRYKWFCGMRDMSGTMSCVWVKF

SEQ ID NO: 1155 - protein, 25 aa, Artificial Sequence
  Synthetic peptide
  MOD_RES (1)..(1): N-terminal acetylation
  DISULFID (4)..(15): Cys residues linked via disulfide bond
  MOD_RES (25)..(25): C-terminal amidation
KWFCGMRDMKGTMSCVWVKFRYDTS

SEQ ID NO: 1156 - protein, 20 aa, Artificial Sequence
  Synthetic peptide
  MOD_RES (1)..(1): N-terminal acetylation
  DISULFID (4)..(15): Cys residues linked via disulfide bond
  MOD_RES (20)..(20): C-terminal amidation
KWFCGMRDMKGTMSCVWVKF

SEQ ID NO: 1157 - protein, 23 aa, Artificial Sequence
  Synthetic peptide
  MOD_RES (1)..(1): N-terminal acetylation
  MOD_RES (23)..(23): C-terminal amidation
SRYKWFAGMRDMKGTMSCVWVKF

SEQ ID NO: 1158 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRAMKGTMSCVWVKF

SEQ ID NO: 1159 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKATMSCVWVKF

SEQ ID NO: 1160 - protein, 23 aa, Artificial Sequence
  Synthetic peptide
  MOD_RES (1)..(1): N-terminal acetylation
  MOD_RES (23)..(23): C-terminal amidation
SRYKWFCGMRDMKGTMSAVWVKF

SEQ ID NO: 1161 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWAKF

SEQ ID NO: 1162 - protein, 23 aa, Artificial Sequence
  Synthetic peptide
  MOD_RES (1)..(1): N-terminal acetylation
  DISULFID (10)..(15): Cys residues linked via disulfide bond
  MOD_RES (23)..(23): C-terminal amidation
SRYKWFGMRCDMKGCTMSVWVKF

SEQ ID NO: 1163 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (18)..(18): Homo-Cys
  MOD_RES (23)..(23): C-terminal amidation
SRYKWFCGMRDMKGTMSCVWVKF

SEQ ID NO: 1164 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SRYKWFCGMRDKGTMSCVWVKF

SEQ ID NO: 1165 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SRYKWFCGMRDMGTMSCVWVKF

SEQ ID NO: 1166 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SRYKWFCGMRDMKGMSCVWVKF

SEQ ID NO: 1167 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (7)..(7): d-Cys
  MOD_RES (21)..(21): C-terminal amidation
SRYKWFCGMRDMKGTMSCVWVKF

SEQ ID NO: 1168 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (11)..(11): D-Asp
  MOD_RES (23)..(23): C-terminal amidation
SRYKWFCGMRDMKGTMSCVWVKF

SEQ ID NO: 1169 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (15)..(15): D-Thr
  MOD_RES (23)..(23): C-terminal amidation
SRYKWFCGMRDMKGTMSCVWVKF

SEQ ID NO: 1170 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (17)..(17): D-Ser
  MOD_RES (23)..(23): C-terminal amidation
SRYKWFCGMRDMKGTMSCVWVKF

SEQ ID NO: 1171 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (18)..(18): D-Cys
  MOD_RES (23)..(23): C-terminal amidation
SRYKWFCGMRDMKGTMSCVWVKF

SEQ ID NO: 1172 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRPMKGTMSCVWVKF

SEQ ID NO: 1173 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMPGTMSCVWVKF

SEQ ID NO: 1174 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGPMSCVWVKF

SEQ ID NO: 1175 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTPSCVWVKF

SEQ ID NO: 1176 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRDKWFCGMRDMKGTMSCVWVKF

SEQ ID NO: 1177 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGDRDMKGTMSCVWVKF

SEQ ID NO: 1178 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGFRDMKGTMSCVWVKF

SEQ ID NO: 1179 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMFDMKGTMSCVWVKF

SEQ ID NO: 1180 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRGKWFCGMRDMKGTMSCVWVKF

SEQ ID NO: 1181 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGGRDMKGTMSCVWVKF

SEQ ID NO: 1182 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCGWVKF

SEQ ID NO: 1183 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCKMRDMKGTMSCVWVKF

SEQ ID NO: 1184 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRKMKGTMSCVWVKF

SEQ ID NO: 1185 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRLMKGTMSCVWVKF

SEQ ID NO: 1186 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGSRDMKGTMSCVWVKF

SEQ ID NO: 1187 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRPKWFCGMRDMKGTMSCVWVKF

SEQ ID NO: 1188 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKP

SEQ ID NO: 1189 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCMMRDMKGTMSCVWVKF

SEQ ID NO: 1190 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCNMRDMKGTMSCVWVKF

SEQ ID NO: 1191 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCWMRDMKGTMSCVWVKF

SEQ ID NO: 1192 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Phe
  MOD_RES (23)..(23): C-terminal amidation
SRYKWFCGFRDMKGTMSCVWVKF

SEQ ID NO: 1193 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Lys
  MOD_RES (23)..(23): C-terminal amidation
SRYKWFCGKRDMKGTMSCVWVKF

SEQ ID NO: 1194 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Leu
  MOD_RES (23)..(23): C-terminal amidation
SRYKWFCGLRDMKGTMSCVWVKF

SEQ ID NO: 1195 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Ser
  MOD_RES (23)..(23): C-terminal amidation
SRYKWFCGSRDMKGTMSCVWVKF

SEQ ID NO: 1196 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Pro
  MOD_RES (23)..(23): C-terminal amidation
SRYKWFCGMRDPKGTMSCVWVKF

SEQ ID NO: 1197 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Ala
  MOD_RES (23)..(23): C-terminal amidation
SRYKWFCGMRDMAGTMSCVWVKF

SEQ ID NO: 1198 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Phe
  MOD_RES (23)..(23): C-terminal amidation
SRYKWFCGMRDMFGTMSCVWVKF

SEQ ID NO: 1199 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Leu
  MOD_RES (23)..(23): C-terminal amidation
SRYKWFCGMRDMLGTMSCVWVKF

SEQ ID NO: 1200 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Pro
  MOD_RES (23)..(23): C-terminal amidation
SRYKWFCGMRDMPGTMSCVWVKF

SEQ ID NO: 1201 - protein, 24 aa, Artificial Sequence
  Synthetic peptide
  MOD_RES (1)..(1): N-terminal acetylation
  MOD_RES (24)..(24): C-terminal amidation
KKSRYKWFCGMRDMKGTMSCVWKK

SEQ ID NO: 1202 - protein, 24 aa, Artificial Sequence
  Synthetic peptide
  MOD_RES (1)..(1): N-terminal acetylation
  MOD_RES (24)..(24): C-terminal amidation
KKKWFCGMRDMKGTMSCVWVKFKK

SEQ ID NO: 1203 - protein, 20 aa, Artificial Sequence
  Synthetic peptide
  MOD_RES (1)..(1): N-terminal acetylation
  DISULFID (4)..(15): Cys residues linked via disulfide bond
  MOD_RES (20)..(20): C-terminal amidation
KWFCGMRDMKGTMSCVWVKF

SEQ ID NO: 1204 - protein, 31 aa, Artificial Sequence
  Synthetic peptide
  MOD_RES (1)..(1): N-terminal acetylation
  MOD_RES (31)..(31): C-terminal amidation
SGASRYKWFSGMRDMKGTMSSVWVKFRYDTS

SEQ ID NO: 1205 - protein, 20 aa, Artificial Sequence
  Synthetic peptide
  MOD_RES (1)..(1): N-terminal acetylation
  MOD_RES (6)..(6): Xaa is (S)-Norleucine
  MOD_RES (9)..(9): Xaa is (S)-Norleucine
  MOD_RES (13)..(13): Xaa is (S)-Norleucine
  MOD_RES (20)..(20): C-terminal amidation
KWFSGXRDXKGTXSSVWVKF

SEQ ID NO: 1206 - protein, 20 aa, Artificial Sequence
  Synthetic peptide
  MOD_RES (1)..(1): N-terminal acetylation
  MOD_RES (20)..(20): C-terminal amidation
SRYKWFCGMRDMKGTMSCVW

SEQ ID NO: 1207 - protein, 20 aa, Artificial Sequence
  Synthetic peptide
  MOD_RES (1)..(1): N-terminal acetylation
  MOD_RES (20)..(20): C-terminal amidation
KWFCGMRDMKGTMSCVWVKF

SEQ ID NO: 1208 - protein, 31 aa, Artificial Sequence
  Synthetic peptide
  MOD_RES (1)..(1): N-terminal acetylation
  MOD_RES (12)..(12): Xaa is (S)-Norleucine
  MOD_RES (15)..(15): Xaa is (S)-Norleucine
  MOD_RES (19)..(19): Xaa is (S)-Norleucine
  MOD_RES (31)..(31): C-terminal amidation
SGASRYKWFSGXRDXKGTXSSVWVKFRYDTS

SEQ ID NO: 1209 - protein, 20 aa, Artificial Sequence
  Synthetic peptide
  MOD_RES (1)..(1): N-terminal acetylation
  DISULFID (4)..(15): Cys residues linked via disulfide bond
  MOD_RES (6)..(6): Xaa is (S)-Norleucine
  MOD_RES (9)..(9): Xaa is (S)-Norleucine
  MOD_RES (13)..(13): Xaa is (S)-Norleucine
  MOD_RES (20)..(20): C-terminal amidation
KWFCGXRDXKGTXSCVWVKF

SEQ ID NO: 1210 - protein, 23 aa, Artificial Sequence
  Synthetic peptide
  MOD_RES (1)..(1): N-terminal acetylation
  MOD_RES (9)..(9): Xaa is (S)-Norleucine
  MOD_RES (12)..(12): Xaa is (S)-Norleucine
  MOD_RES (16)..(16): Xaa is (S)-Norleucine
  MOD_RES (23)..(23): C-terminal amidation
SRYKWFSGXRDXKGTXSSVWVKF

SEQ ID NO: 1211 - protein, 31 aa, Artificial Sequence
  Synthetic peptide
  MOD_RES (1)..(1): N-terminal acetylation
  DISULFID (10)..(21): Cys residues linked via disulfide bond
  MOD_RES (31)..(31): C-terminal amidation
RKRDVSGKMCWSGFGSKWFRCADMMTYYSVT

SEQ ID NO: 1212 - protein, 31 aa, Artificial Sequence
  Synthetic peptide
  MOD_RES (1)..(1): N-terminal acetylation
  DISULFID (10)..(21): Cys residues linked via disulfide bond
  MOD_RES (31)..(31): C-terminal amidation
RWSGKSTYSCDAMVRRMGMKCFSFGWTDVYK

SEQ ID NO: 1213 - protein, 31 aa, Artificial Sequence; identical to SEQ ID NO: 1047
  Synthetic peptide
  MOD_RES (1)..(1): N-terminal acetylation
  MOD_RES (31)..(31): C-terminal amidation

SEQ ID NO: 1214 - protein, 24 aa, Artificial Sequence
  Synthetic peptide
  MOD_RES (1)..(1): N-terminal acetylation
  MOD_RES (24)..(24): C-terminal amidation
KKSGASRYKWFCGMRDMKGTMSKK

SEQ ID NO: 1215 - protein, 24 aa, Artificial Sequence
  Synthetic peptide
  MOD_RES (1)..(1): N-terminal acetylation
  MOD_RES (24)..(24): C-terminal amidation
KKCGMRDMKGTMSCVWVKFRYDKK

SEQ ID NO: 1216 - protein, 24 aa, Artificial Sequence
  Synthetic peptide
  MOD_RES (1)..(1): N-terminal acetylation
  MOD_RES (24)..(24): C-terminal amidation
KKMRDMKGTMSCVWVKFRYDTSKK

SEQ ID NO: 1217 - protein, 22 aa, Artificial Sequence
  Synthetic peptide
  MOD_RES (1)..(1): N-terminal acetylation
  DISULFID (10)..(21): Cys residues linked via disulfide bond
  MOD_RES (22)..(22): C-terminal amidation
SGASRYKWFCGMRDMKGTMSCV

SEQ ID NO: 1218 - protein, 19 aa, Artificial Sequence
  Synthetic peptide
  MOD_RES (1)..(1): N-terminal acetylation
  MOD_RES (19)..(19): C-terminal amidation
SGASRYKWFCGMRDMKGTM

SEQ ID NO: 1219 - protein, 22 aa, Artificial Sequence
  Synthetic peptide
  MOD_RES (1)..(1): N-terminal acetylation
  DISULFID (1)..(12): Cys residues linked via disulfide bond
  MOD_RES (22)..(22): C-terminal amidation
CGMRDMKGTMSCVWVKFRYDTS

SEQ ID NO: 1220 - protein, 19 aa, Artificial Sequence
  Synthetic peptide
  MOD_RES (1)..(1): N-terminal acetylation
  MOD_RES (19)..(19): C-terminal amidation
RDMKGTMSCVWVKFRYDTS

SEQ ID NO: 1221 - protein, 19 aa, Artificial Sequence
  Synthetic peptide
  MOD_RES (1)..(1): N-terminal acetylation
  MOD_RES (19)..(19): C-terminal amidation
RDMKGTMSCVWVKFRYDTS

SEQ ID NO: 1222 - protein, 20 aa, Artificial Sequence
  Synthetic peptide
  MOD_RES (1)..(1): N-terminal acetylation
  MOD_RES (20)..(20): C-terminal amidation
SGASRYKWFCGMRDMKGTMS

SEQ ID NO: 1223 - protein, 20 aa, Artificial Sequence
  Synthetic peptide
  MOD_RES (1)..(1): N-terminal acetylation
  DISULFID (7)..(18): Cys residues linked via disulfide bond
  MOD_RES (20)..(20): C-terminal amidation
SRYKWFCGMRDMKGTMSCVW

SEQ ID NO: 1224 - protein, 20 aa, Artificial Sequence
  Synthetic peptide
  MOD_RES (1)..(1): N-terminal acetylation
  DISULFID (1)..(12): Cys residues linked via disulfide bond
  MOD_RES (20)..(20): C-terminal amidation
CGMRDMKGTMSCVWVKFRYD

SEQ ID NO: 1225 - protein, 20 aa, Artificial Sequence
  Synthetic peptide
  MOD_RES (1)..(1): N-terminal acetylation
  MOD_RES (20)..(20): C-terminal amidation
MRDMKGTMSCVWVKFRYDTS

SEQ ID NO: 1226 - protein, 20 aa, Artificial Sequence
  Synthetic peptide
  MOD_RES (1)..(1): N-terminal acetylation
  MOD_RES (20)..(20): C-terminal amidation
MRDMKGTMSCVWVKFRYDTS

SEQ ID NO: 1227 - protein, 20 aa, Artificial Sequence
  Synthetic peptide
  MOD_RES (1)..(1): N-terminal acetylation
  MOD_RES (20)..(20): C-terminal amidation
CGMRDMKGTMSCVWVKFRYD

SEQ ID NO: 1228 - protein, 20 aa, Artificial Sequence
  Synthetic peptide
  MOD_RES (1)..(1): N-terminal acetylation
  MOD_RES (20)..(20): C-terminal amidation
KWFSGMRDMKGTMSSVWVKF

SEQ ID NO: 1229 - protein, 23 aa, Artificial Sequence
  Synthetic peptide
  MOD_RES (1)..(1): N-terminal acetylation
  MOD_RES (23)..(23): C-terminal amidation
SRYKWFSGMRDMKGTMSSVWVKF

SEQ ID NO: 1230 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (20)..(20): C-terminal amidation
SRYKAFCGMRDMKGTMSCVWVKF

SEQ ID NO: 1231 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWACGMRDMKGTMSCVWVKF

SEQ ID NO: 1232 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVAVKF

SEQ ID NO: 1233 - protein, 23 aa, Artificial Sequence
  Synthetic peptide
  MOD_RES (1)..(1): N-terminal acetylation
  DISULFID (9)..(18): Cys residues linked via disulfide bond
  MOD_RES (23)..(23): C-terminal amidation
SRYKWFGMCRDMKGTMSCVWVKF

SEQ ID NO: 1234 - protein, 23 aa, Artificial Sequence
  Synthetic peptide
  MOD_RES (1)..(1): N-terminal acetylation
  DISULFID (11)..(18): Cys residues linked via disulfide bond
  MOD_RES (23)..(23): C-terminal amidation
SRYKWFGMRDCMKGTMSCVWVKF

SEQ ID NO: 1235 - protein, 23 aa, Artificial Sequence
  Synthetic peptide
  MOD_RES (1)..(1): N-terminal acetylation
  DISULFID (13)..(18): Cys residues linked via disulfide bond
  MOD_RES (23)..(23): C-terminal amidation
SRYKWFGMRDMKCGTMSCVWVKF

SEQ ID NO: 1236 - protein, 23 aa, Artificial Sequence
  Synthetic peptide
  MOD_RES (1)..(1): N-terminal acetylation
  DISULFID (7)..(16): Cys residues linked via disulfide bond
  MOD_RES (23)..(23): C-terminal amidation
SRYKWFCGMRDMKGTCMSVWVKF

SEQ ID NO: 1237 - protein, 23 aa, Artificial Sequence
  Synthetic peptide
  MOD_RES (1)..(1): N-terminal acetylation
  DISULFID (7)..(14): Cys residues linked via disulfide bond
  MOD_RES (23)..(23): C-terminal amidation
SRYKWFCGMRDMKCGTMSVWVKF

SEQ ID NO: 1238 - protein, 23 aa, Artificial Sequence
  Synthetic peptide
  MOD_RES (1)..(1): N-terminal acetylation
  DISULFID (7)..(12): Cys residues linked via disulfide bond
  MOD_RES (23)..(23): C-terminal amidation
SRYKWFCGMRDCMKGTMSVWVKF

SEQ ID NO: 1239 - protein, 23 aa, Artificial Sequence
  Synthetic peptide
  MOD_RES (1)..(1): N-terminal acetylation
  DISULFID (8)..(17): Cys residues linked via disulfide bond
  MOD_RES (23)..(23): C-terminal amidation
SRYKWFGCMRDMKGTMCSVWVKF

SEQ ID NO: 1240 - protein, 23 aa, Artificial Sequence
  Synthetic peptide
  MOD_RES (1)..(1): N-terminal acetylation
  DISULFID (9)..(16): Cys residues linked via disulfide bond
  MOD_RES (23)..(23): C-terminal amidation
SRYKWFGMCRDMKGTCMSVWVKF

SEQ ID NO: 1241 - protein, 23 aa, Artificial Sequence
  Synthetic peptide
  MOD_RES (1)..(1): N-terminal acetylation
  MOD_RES (7)..(7): Homo-Cys
  DISULFID (7)..(18): Cys residues linked via disulfide bond
  MOD_RES (18)..(18): Homo-Cys
  MOD_RES (23)..(23): C-terminal amidation
SRYKWFCGMRDMKGTMSCVWVKF

SEQ ID NO: 1242 - protein, 23 aa, Artificial Sequence
  Synthetic peptide
  MOD_RES (1)..(1): N-terminal acetylation
  MOD_RES (7)..(7): Xaa is (S)-Diaminopropionic acid
  DISULFID (7)..(18): Cys residues linked via disulfide bond
  MOD_RES (23)..(23): C-terminal amidation
SRYKWFXGMRDMKGTMSDVWVKF

SEQ ID NO: 1243 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFKGMRDMKGTMSDVWVKF

SEQ ID NO: 1244 - protein, 22 aa, Artificial Sequence
  Synthetic peptide
  MOD_RES (1)..(1): N-terminal acetylation
  DISULFID (7)..(17): Cys residues linked via disulfide bond
  MOD_RES (22)..(22): C-terminal amidation
SRYKWFCMRDMKGTMSCVWVKF

SEQ ID NO: 1245 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (10)..(10): D-Arg
  MOD_RES (23)..(23): C-terminal amidation
SRYKWFCGMRDMKGTMSCVWVKF

SEQ ID NO: 1246 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (16)..(16): D-Met
  MOD_RES (23)..(23): C-terminal amidation
SRYKWFCGMRDMKGTMSCVWVKF

SEQ ID NO: 1247 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCPMRDMKGTMSCVWVKF

SEQ ID NO: 1248 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGPRDMKGTMSCVWVKF

SEQ ID NO: 1249 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKPTMSCVWVKF

SEQ ID NO: 1250 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMPCVWVKF

SEQ ID NO: 1251 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKDFCGMRDMKGTMSCVWVKF

SEQ ID NO: 1252 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWDCGMRDMKGTMSCVWVKF

SEQ ID NO: 1253 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCDMRDMKGTMSCVWVKF

SEQ ID NO: 1254 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMDDMKGTMSCVWVKF

SEQ ID NO: 1255 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCDWVKF

SEQ ID NO: 1256 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVDVKF

SEQ ID NO: 1257 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWDKF

SEQ ID NO: 1258 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKFFCGMRDMKGTMSCVWVKF

SEQ ID NO: 1259 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCFMRDMKGTMSCVWVKF

SEQ ID NO: 1260 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRFMKGTMSCVWVKF

SEQ ID NO: 1261 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWFKF

SEQ ID NO: 1262 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVFF

SEQ ID NO: 1263 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKGFCGMRDMKGTMSCVWVKF

SEQ ID NO: 1264 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWGCGMRDMKGTMSCVWVKF

SEQ ID NO: 1265 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVGVKF

SEQ ID NO: 1266 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWGKF

SEQ ID NO: 1267 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKKFCGMRDMKGTMSCVWVKF

SEQ ID NO: 1268 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCKWVKF

SEQ ID NO: 1269 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVKVKF

SEQ ID NO: 1270 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWKKF

SEQ ID NO: 1271 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKLFCGMRDMKGTMSCVWVKF

SEQ ID NO: 1272 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCLMRDMKGTMSCVWVKF

SEQ ID NO: 1273 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVLVKF

SEQ ID NO: 1274 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKSFCGMRDMKGTMSCVWVKF

SEQ ID NO: 1275 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWSCGMRDMKGTMSCVWVKF

SEQ ID NO: 1276 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVSVKF

SEQ ID NO: 1277 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWSKF

SEQ ID NO: 1278 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYPWFCGMRDMKGTMSCVWVKF

SEQ ID NO: 1279 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKPFCGMRDMKGTMSCVWVKF

SEQ ID NO: 1280 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWPCGMRDMKGTMSCVWVKF

SEQ ID NO: 1281 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCPWVKF

SEQ ID NO: 1282 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVPVKF

SEQ ID NO: 1283 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWPKF

SEQ ID NO: 1284 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (20)..(20): C-terminal amidation
SRYKWFCEMRDMKGTMSCVWVKF

SEQ ID NO: 1285 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCHMRDMKGTMSCVWVKF

SEQ ID NO: 1286 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCIMRDMKGTMSCVWVKF

SEQ ID NO: 1287 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCVMRDMKGTMSCVWVKF

SEQ ID NO: 1288 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCYMRDMKGTMSCVWVKF

SEQ ID NO: 1289 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Asp
  MOD_RES (23)..(23): C-terminal amidation
SRYKWFCGDRDMKGTMSCVWVKF

SEQ ID NO: 1290 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  DISULFID (11)..(22): Cys residues linked via disufide bond
  MOD_RES (32)..(32): C-terminal amidation
XSGASRYKWFCGMRDMKGTMSCVWVKFRYDTS

SEQ ID NO: 1291 - protein, 24 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  DISULFID (8)..(19): Cys residues linked via disulfide bond
  MOD_RES (24)..(24): C-terminal amidation
XSRYKWFCGMRDMKGTMSCVWVKF

SEQ ID NO: 1292 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKF

SEQ ID NO: 1293 - protein, 31 aa, Artificial Sequence
  Synthetic peptide
  MOD_RES (1)..(1): N-terminal acetylation
  MOD_RES (31)..(31): C-terminal amidation
SGGRKHKHFLRSNGKPSRALSSMHFWRWSTS

SEQ ID NO: 1294-2000 - skipped (707 entries)

SEQ ID NO: 2001 - protein, 31 aa, Artificial Sequence
  Synthetic peptide
  MOD_RES (1)..(1): N-terminal acetylation
  MOD_RES (31)..(31): C-terminal amidation
SGYASFALAVQLHVSKRSKEMALARLYYKTS

SEQ ID NO: 2002 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYKTS

SEQ ID NO: 2003 - protein, 35 aa, Artificial Sequence
  Synthetic peptide
  MOD_RES (1)..(1): N-terminal acetylation
  MOD_RES (35)..(35): C-terminal amidation
KKSGYASFPLAVQLHVSKRSKEMALARLYYKTSKK

SEQ ID NO: 2004 - protein, 31 aa, Artificial Sequence
  Synthetic peptide
  MOD_RES (1)..(1): N-terminal acetylation
  MOD_RES (31)..(31): C-terminal amidation
AGYASFPLAVQLHVSKRSKEMALARLYYKTS

SEQ ID NO: 2005 - protein, 31 aa, Artificial Sequence
  Synthetic peptide
  MOD_RES (1)..(1): N-terminal acetylation
  MOD_RES (31)..(31): C-terminal amidation
SAYASFPLAVQLHVSKRSKEMALARLYYKTS

SEQ ID NO: 2006 - protein, 31 aa, Artificial Sequence
  Synthetic peptide
  MOD_RES (1)..(1): N-terminal acetylation
  MOD_RES (31)..(31): C-terminal amidation
SGYAAFPLAVQLHVSKRSKEMALARLYYKTS

SEQ ID NO: 2007 - protein, 31 aa, Artificial Sequence
  Synthetic peptide
  MOD_RES (1)..(1): N-terminal acetylation
  MOD_RES (31)..(31): C-terminal amidation
SGYASFPLAVALHVSKRSKEMALARLYYKTS

SEQ ID NO: 2008 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVAKRSKEMALARLYYKTS

SEQ ID NO: 2009 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRAKEMALARLYYKTS

SEQ ID NO: 2010 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSAEMALARLYYKTS

SEQ ID NO: 2011 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALAALYYKTS

SEQ ID NO: 2012 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYATS

SEQ ID NO: 2013 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYKAS

SEQ ID NO: 2014 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYKTA

SEQ ID NO: 2015 - protein, 21 aa, Artificial Sequence
  Synthetic peptide
  MOD_RES (1)..(1): N-terminal acetylation
  MOD_RES (21)..(21): C-terminal amidation
GYASFPLAVQLHVAKRSKEMA

SEQ ID NO: 2016 - protein, 32 aa, Artificial Sequence
  Synthetic peptide
  MOD_RES (1)..(1): N-terminal acetylation
  MOD_RES (32)..(32): C-terminal amidation
KKASFPLAVQLHVSKRSKEMALARLYYKTSKK

SEQ ID NO: 2017 - protein, 25 aa, Artificial Sequence
  Synthetic peptide
  MOD_RES (1)..(1): N-terminal acetylation
  MOD_RES (25)..(25): C-terminal amidation
ASFPLAVQLHVSKRSKEMALARLYY

SEQ ID NO: 2018 - protein, 31 aa, Artificial Sequence
  Synthetic peptide
  MOD_RES (1)..(1): N-terminal acetylation
  MOD_RES (31)..(31): C-terminal amidation
SGYASFPAAVQLHVSKRSKEMALARLYYKTS

SEQ ID NO: 2019 - protein, 31 aa, Artificial Sequence
  Synthetic peptide
  MOD_RES (1)..(1): N-terminal acetylation
  MOD_RES (31)..(31): C-terminal amidation
SGYASFPLAVQAHVSKRSKEMALARLYYKTS

SEQ ID NO: 2020 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKAMALARLYYKTS

SEQ ID NO: 2021 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARAYYKTS

SEQ ID NO: 2022 - protein, 21 aa, Artificial Sequence
  Synthetic peptide
  MOD_RES (1)..(1): N-terminal acetylation
  MOD_RES (21)..(21): C-terminal amidation
GYASFPLAVQLHVMKRSKEMA

SEQ ID NO: 2023 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMA

SEQ ID NO: 2024 - protein, 21 aa, Artificial Sequence
  Synthetic peptide
  MOD_RES (1)..(1): N-terminal acetylation
  MOD_RES (21)..(21): C-terminal amidation
AYASFPWFVQLHVHKRSWEMA

SEQ ID NO: 2025 - protein, 21 aa, Artificial Sequence
  Synthetic peptide
  MOD_RES (1)..(1): N-terminal acetylation
  MOD_RES (21)..(21): C-terminal amidation
GYAAFPWFVQLHVHKRSWEMA

SEQ ID NO: 2026 - protein, 21 aa, Artificial Sequence
  Synthetic peptide
  MOD_RES (1)..(1): N-terminal acetylation
  MOD_RES (21)..(21): C-terminal amidation
GYASFPWAVQLHVHKRSWEMA

SEQ ID NO: 2027 - protein, 21 aa, Artificial Sequence
  Synthetic peptide
  MOD_RES (1)..(1): N-terminal acetylation
  MOD_RES (21)..(21): C-terminal amidation
GYASFPWFVALHVHKRSWEMA

SEQ ID NO: 2028 - protein, 21 aa, Artificial Sequence
  Synthetic peptide
  MOD_RES (1)..(1): N-terminal acetylation
  MOD_RES (21)..(21): C-terminal amidation
CYASFPWFVQLHVHKRSWEMA

SEQ ID NO: 2029 - protein, 21 aa, Artificial Sequence
  Synthetic peptide
  MOD_RES (1)..(1): N-terminal acetylation
  MOD_RES (21)..(21): C-terminal amidation
GCASFPWFVQLHVHKRSWEMA

SEQ ID NO: 2030 - protein, 21 aa, Artificial Sequence
  Synthetic peptide
  MOD_RES (1)..(1): N-terminal acetylation
  MOD_RES (21)..(21): C-terminal amidation
GYCSFPWFVQLHVHKRSWEMA

SEQ ID NO: 2031 - protein, 21 aa, Artificial Sequence
  Synthetic peptide
  MOD_RES (1)..(1): N-terminal acetylation
  MOD_RES (21)..(21): C-terminal amidation
GYACFPWFVQLHVHKRSWEMA

SEQ ID NO: 2032 - protein, 21 aa, Artificial Sequence
  Synthetic peptide
  MOD_RES (1)..(1): N-terminal acetylation
  MOD_RES (21)..(21): C-terminal amidation
GYASCPWFVQLHVHKRSWEMA

SEQ ID NO: 2033 - protein, 21 aa, Artificial Sequence
  Synthetic peptide
  MOD_RES (1)..(1): N-terminal acetylation
  MOD_RES (21)..(21): C-terminal amidation
GYASFPCFVQLHVHKRSWEMA

SEQ ID NO: 2034 - protein, 21 aa, Artificial Sequence
  Synthetic peptide
  MOD_RES (1)..(1): N-terminal acetylation
  MOD_RES (21)..(21): C-terminal amidation
GYASFPWCVQLHVHKRSWEMA

SEQ ID NO: 2035 - protein, 21 aa, Artificial Sequence
  Synthetic peptide
  MOD_RES (1)..(1): N-terminal acetylation
  MOD_RES (21)..(21): C-terminal amidation
GYASFPWFCQLHVHKRSWEMA

SEQ ID NO: 2036 - protein, 21 aa, Artificial Sequence
  Synthetic peptide
  MOD_RES (1)..(1): N-terminal acetylation
  MOD_RES (21)..(21): C-terminal amidation
GYASFPWFVCLHVHKRSWEMA

SEQ ID NO: 2037 - protein, 21 aa, Artificial Sequence
  Synthetic peptide
  MOD_RES (1)..(1): N-terminal acetylation
  MOD_RES (21)..(21): C-terminal amidation
GYASFPWFVQLHCHKRSWEMA

SEQ ID NO: 2038 - protein, 21 aa, Artificial Sequence
  Synthetic peptide
  MOD_RES (1)..(1): N-terminal acetylation
  MOD_RES (21)..(21): C-terminal amidation
GYASFPWFVQLHVCKRSWEMA

SEQ ID NO: 2039 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRCWEMA

SEQ ID NO: 2040 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSCEMA

SEQ ID NO: 2041 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWCMA

SEQ ID NO: 2042 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWECA

SEQ ID NO: 2043 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMC

SEQ ID NO: 2044 - protein, 21 aa, Artificial Sequence
  Synthetic peptide
  MOD_RES (1)..(1): N-terminal acetylation
  MOD_RES (21)..(21): C-terminal amidation
DYASFPWFVQLHVHKRSWEMA

SEQ ID NO: 2045 - protein, 21 aa, Artificial Sequence
  Synthetic peptide
  MOD_RES (1)..(1): N-terminal acetylation
  MOD_RES (21)..(21): C-terminal amidation
GYASFPWFVQLHVFKRSWEMA

SEQ ID NO: 2046 - protein, 21 aa, Artificial Sequence
  Synthetic peptide
  MOD_RES (1)..(1): N-terminal acetylation
  MOD_RES (21)..(21): C-terminal amidation
GYGSFPWFVQLHVHKRSWEMA

SEQ ID NO: 2047 - protein, 21 aa, Artificial Sequence
  Synthetic peptide
  MOD_RES (1)..(1): N-terminal acetylation
  MOD_RES (21)..(21): C-terminal amidation
GYAGFPWFVQLHVHKRSWEMA

SEQ ID NO: 2048 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRGWEMA

SEQ ID NO: 2049 - protein, 21 aa, Artificial Sequence
  Synthetic peptide
  MOD_RES (1)..(1): N-terminal acetylation
  MOD_RES (21)..(21): C-terminal amidation
GYHSFPWFVQLHVHKRSWEMA

SEQ ID NO: 2050 - protein, 21 aa, Artificial Sequence
  Synthetic peptide
  MOD_RES (1)..(1): N-terminal acetylation
  MOD_RES (21)..(21): C-terminal amidation
GYAHFPWFVQLHVHKRSWEMA

SEQ ID NO: 2051 - protein, 21 aa, Artificial Sequence
  Synthetic peptide
  MOD_RES (1)..(1): N-terminal acetylation
  MOD_RES (21)..(21): C-terminal amidation
GYASHPWFVQLHVHKRSWEMA

SEQ ID NO: 2052 - protein, 21 aa, Artificial Sequence
  Synthetic peptide
  MOD_RES (1)..(1): N-terminal acetylation
  MOD_RES (21)..(21): C-terminal amidation
GYASFPWHVQLHVHKRSWEMA

SEQ ID NO: 2053 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWHMA

SEQ ID NO: 2054 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMH

SEQ ID NO: 2055 - protein, 21 aa, Artificial Sequence
  Synthetic peptide
  MOD_RES (1)..(1): N-terminal acetylation
  MOD_RES (21)..(21): C-terminal amidation
GYISFPWFVQLHVHKRSWEMA

SEQ ID NO: 2056 - protein, 21 aa, Artificial Sequence
  Synthetic peptide
  MOD_RES (1)..(1): N-terminal acetylation
  MOD_RES (21)..(21): C-terminal amidation
GYAIFPWFVQLHVHKRSWEMA

SEQ ID NO: 2057 - protein, 21 aa, Artificial Sequence
  Synthetic peptide
  MOD_RES (1)..(1): N-terminal acetylation
  MOD_RES (21)..(21): C-terminal amidation
GYASFPWFVQIHVHKRSWEMA

SEQ ID NO: 2058 - protein, 21 aa, Artificial Sequence
  Synthetic peptide
  MOD_RES (1)..(1): N-terminal acetylation
  MOD_RES (21)..(21): C-terminal amidation
GYASFPWFVQLHVIKRSWEMA

SEQ ID NO: 2059 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRIWEMA

SEQ ID NO: 2060 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSIEMA

SEQ ID NO: 2061 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMI

SEQ ID NO: 2062 - protein, 21 aa, Artificial Sequence
  Synthetic peptide
  MOD_RES (1)..(1): N-terminal acetylation
  MOD_RES (21)..(21): C-terminal amidation
KYASFPWFVQLHVHKRSWEMA

SEQ ID NO: 2063 - protein, 21 aa, Artificial Sequence
  Synthetic peptide
  MOD_RES (1)..(1): N-terminal acetylation
  MOD_RES (21)..(21): C-terminal amidation
GKASFPWFVQLHVHKRSWEMA

SEQ ID NO: 2064 - protein, 21 aa, Artificial Sequence
  Synthetic peptide
  MOD_RES (1)..(1): N-terminal acetylation
  MOD_RES (21)..(21): C-terminal amidation
GYKSFPWFVQLHVHKRSWEMA

SEQ ID NO: 2065 - protein, 21 aa, Artificial Sequence
  Synthetic peptide
  MOD_RES (1)..(1): N-terminal acetylation
  MOD_RES (21)..(21): C-terminal amidation
GYAKFPWFVQLHVHKRSWEMA

SEQ ID NO: 2066 - protein, 21 aa, Artificial Sequence
  Synthetic peptide
  MOD_RES (1)..(1): N-terminal acetylation
  MOD_RES (21)..(21): C-terminal amidation
GYASKPWFVQLHVHKRSWEMA

SEQ ID NO: 2067 - protein, 21 aa, Artificial Sequence
  Synthetic peptide
  MOD_RES (1)..(1): N-terminal acetylation
  MOD_RES (21)..(21): C-terminal amidation
GYASFPWKVQLHVHKRSWEMA

SEQ ID NO: 2068 - protein, 21 aa, Artificial Sequence
  Synthetic peptide
  MOD_RES (1)..(1): N-terminal acetylation
  MOD_RES (21)..(21): C-terminal amidation
GYASFPWFVKLHVHKRSWEMA

SEQ ID NO: 2069 - protein, 21 aa, Artificial Sequence
  Synthetic peptide
  MOD_RES (1)..(1): N-terminal acetylation
  MOD_RES (21)..(21): C-terminal amidation
GYASFPWFVQKHVHKRSWEMA

SEQ ID NO: 2070 - protein, 21 aa, Artificial Sequence
  Synthetic peptide
  MOD_RES (1)..(1): N-terminal acetylation
  MOD_RES (21)..(21): C-terminal amidation
GYASFPWFVQLHKHKRSWEMA

SEQ ID NO: 2071 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRKWEMA

SEQ ID NO: 2072 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWKMA

SEQ ID NO: 2073 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMK

SEQ ID NO: 2074 - protein, 21 aa, Artificial Sequence
  Synthetic peptide
  MOD_RES (1)..(1): N-terminal acetylation
  MOD_RES (21)..(21): C-terminal amidation
LYASFPWFVQLHVHKRSWEMA

SEQ ID NO: 2075 - protein, 21 aa, Artificial Sequence
  Synthetic peptide
  MOD_RES (1)..(1): N-terminal acetylation
  MOD_RES (21)..(21): C-terminal amidation
GYLSFPWFVQLHVHKRSWEMA

SEQ ID NO: 2076 - protein, 21 aa, Artificial Sequence
  Synthetic peptide
  MOD_RES (1)..(1): N-terminal acetylation
  MOD_RES (21)..(21): C-terminal amidation
GYALFPWFVQLHVHKRSWEMA

SEQ ID NO: 2077 - protein, 21 aa, Artificial Sequence
  Synthetic peptide
  MOD_RES (1)..(1): N-terminal acetylation
  MOD_RES (21)..(21): C-terminal amidation
GYASFPWFVLLHVHKRSWEMA

SEQ ID NO: 2078 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRLWEMA

SEQ ID NO: 2079 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEML

SEQ ID NO: 2080 - protein, 21 aa, Artificial Sequence
  Synthetic peptide
  MOD_RES (1)..(1): N-terminal acetylation
  MOD_RES (21)..(21): C-terminal amidation
MYASFPWFVQLHVHKRSWEMA

SEQ ID NO: 2081 - protein, 21 aa, Artificial Sequence
  Synthetic peptide
  MOD_RES (1)..(1): N-terminal acetylation
  MOD_RES (21)..(21): C-terminal amidation
GYMSFPWFVQLHVHKRSWEMA

SEQ ID NO: 2082 - protein, 21 aa, Artificial Sequence
  Synthetic peptide
  MOD_RES (1)..(1): N-terminal acetylation
  MOD_RES (21)..(21): C-terminal amidation
GYAMFPWFVQLHVHKRSWEMA

SEQ ID NO: 2083 - protein, 21 aa, Artificial Sequence
  Synthetic peptide
  MOD_RES (1)..(1): N-terminal acetylation
  MOD_RES (21)..(21): C-terminal amidation
GYASFPWFVQMHVHKRSWEMA

SEQ ID NO: 2084 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMM

SEQ ID NO: 2085 - protein, 21 aa, Artificial Sequence
  Synthetic peptide
  MOD_RES (1)..(1): N-terminal acetylation
  MOD_RES (21)..(21): C-terminal amidation
NYASFPWFVQLHVHKRSWEMA

SEQ ID NO: 2086 - protein, 21 aa, Artificial Sequence
  Synthetic peptide
  MOD_RES (1)..(1): N-terminal acetylation
  MOD_RES (21)..(21): C-terminal amidation
GYANFPWFVQLHVHKRSWEMA

SEQ ID NO: 2087 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRNWEMA

SEQ ID NO: 2088 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMN

SEQ ID NO: 2089 - protein, 21 aa, Artificial Sequence
  Synthetic peptide
  MOD_RES (1)..(1): N-terminal acetylation
  MOD_RES (21)..(21): C-terminal amidation
PYASFPWFVQLHVHKRSWEMA

SEQ ID NO: 2090 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRQWEMA

SEQ ID NO: 2091 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMQ

SEQ ID NO: 2092 - protein, 21 aa, Artificial Sequence
  Synthetic peptide
  MOD_RES (1)..(1): N-terminal acetylation
  MOD_RES (21)..(21): C-terminal amidation
RYASFPWFVQLHVHKRSWEMA

SEQ ID NO: 2093 - protein, 21 aa, Artificial Sequence
  Synthetic peptide
  MOD_RES (1)..(1): N-terminal acetylation
  MOD_RES (21)..(21): C-terminal amidation
GRASFPWFVQLHVHKRSWEMA

SEQ ID NO: 2094 - protein, 21 aa, Artificial Sequence
  Synthetic peptide
  MOD_RES (1)..(1): N-terminal acetylation
  MOD_RES (21)..(21): C-terminal amidation
GYRSFPWFVQLHVHKRSWEMA

SEQ ID NO: 2095 - protein, 21 aa, Artificial Sequence
  Synthetic peptide
  MOD_RES (1)..(1): N-terminal acetylation
  MOD_RES (21)..(21): C-terminal amidation
GYARFPWFVQLHVHKRSWEMA

SEQ ID NO: 2096 - protein, 21 aa, Artificial Sequence
  Synthetic peptide
  MOD_RES (1)..(1): N-terminal acetylation
  MOD_RES (21)..(21): C-terminal amidation
GYASRPWFVQLHVHKRSWEMA

SEQ ID NO: 2097 - protein, 21 aa, Artificial Sequence
  Synthetic peptide
  MOD_RES (1)..(1): N-terminal acetylation
  MOD_RES (21)..(21): C-terminal amidation
GYASFPRFVQLHVHKRSWEMA

SEQ ID NO: 2098 - protein, 21 aa, Artificial Sequence
  Synthetic peptide
  MOD_RES (1)..(1): N-terminal acetylation
  MOD_RES (21)..(21): C-terminal amidation
GYASFPWRVQLHVHKRSWEMA

SEQ ID NO: 2099 - protein, 21 aa, Artificial Sequence
  Synthetic peptide
  MOD_RES (1)..(1): N-terminal acetylation
  MOD_RES (21)..(21): C-terminal amidation
GYASFPWFRQLHVHKRSWEMA

SEQ ID NO: 2100 - protein, 21 aa, Artificial Sequence
  Synthetic peptide
  MOD_RES (1)..(1): N-terminal acetylation
  MOD_RES (21)..(21): C-terminal amidation
GYASFPWFVRLHVHKRSWEMA

SEQ ID NO: 2101 - protein, 21 aa, Artificial Sequence
  Synthetic peptide
  MOD_RES (1)..(1): N-terminal acetylation
  MOD_RES (21)..(21): C-terminal amidation
GYASFPWFVQRHVHKRSWEMA

SEQ ID NO: 2102 - protein, 21 aa, Artificial Sequence
  Synthetic peptide
  MOD_RES (1)..(1): N-terminal acetylation
  MOD_RES (21)..(21): C-terminal amidation
GYASFPWFVQLHRHKRSWEMA

SEQ ID NO: 2103 - protein, 21 aa, Artificial Sequence
  Synthetic peptide
  MOD_RES (1)..(1): N-terminal acetylation
  MOD_RES (21)..(21): C-terminal amidation
GYASFPWFVQLHVRKRSWEMA

SEQ ID NO: 2104 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHRRSWEMA

SEQ ID NO: 2105 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRRWEMA

SEQ ID NO: 2106 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSREMA

SEQ ID NO: 2107 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWRMA

SEQ ID NO: 2108 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMR

SEQ ID NO: 2109 - protein, 21 aa, Artificial Sequence
  Synthetic peptide
  MOD_RES (1)..(1): N-terminal acetylation
  MOD_RES (21)..(21): C-terminal amidation
SYASFPWFVQLHVHKRSWEMA

SEQ ID NO: 2110 - protein, 21 aa, Artificial Sequence
  Synthetic peptide
  MOD_RES (1)..(1): N-terminal acetylation
  MOD_RES (21)..(21): C-terminal amidation
GYSSFPWFVQLHVHKRSWEMA

SEQ ID NO: 2111 - protein, 21 aa, Artificial Sequence
  Synthetic peptide
  MOD_RES (1)..(1): N-terminal acetylation
  MOD_RES (21)..(21): C-terminal amidation
GYASFPWFVSLHVHKRSWEMA

SEQ ID NO: 2112 - protein, 21 aa, Artificial Sequence
  Synthetic peptide
  MOD_RES (1)..(1): N-terminal acetylation
  MOD_RES (21)..(21): C-terminal amidation
TYASFPWFVQLHVHKRSWEMA

SEQ ID NO: 2113 - protein, 21 aa, Artificial Sequence
  Synthetic peptide
  MOD_RES (1)..(1): N-terminal acetylation
  MOD_RES (21)..(21): C-terminal amidation
GYTSFPWFVQLHVHKRSWEMA

SEQ ID NO: 2114 - protein, 21 aa, Artificial Sequence
  Synthetic peptide
  MOD_RES (1)..(1): N-terminal acetylation
  MOD_RES (21)..(21): C-terminal amidation
GYATFPWFVQLHVHKRSWEMA

SEQ ID NO: 2115 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRTWEMA

SEQ ID NO: 2116 - protein, 21 aa, Artificial Sequence
  Synthetic peptide
  MOD_RES (1)..(1): N-terminal acetylation
  MOD_RES (21)..(21): C-terminal amidation
GYASFPWVVQLHVHKRSWEMA

SEQ ID NO: 2117 - protein, 21 aa, Artificial Sequence
  Synthetic peptide
  MOD_RES (1)..(1): N-terminal acetylation
  MOD_RES (21)..(21): C-terminal amidation
GYASFPWFVQVHVHKRSWEMA

SEQ ID NO: 2118 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRVWEMA

SEQ ID NO: 2119 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMV

SEQ ID NO: 2120 - protein, 21 aa, Artificial Sequence
  Synthetic peptide
  MOD_RES (1)..(1): N-terminal acetylation
  MOD_RES (21)..(21): C-terminal amidation
GWASFPWFVQLHVHKRSWEMA

SEQ ID NO: 2121 - protein, 21 aa, Artificial Sequence
  Synthetic peptide
  MOD_RES (1)..(1): N-terminal acetylation
  MOD_RES (21)..(21): C-terminal amidation
GYWSFPWFVQLHVHKRSWEMA

SEQ ID NO: 2122 - protein, 21 aa, Artificial Sequence
  Synthetic peptide
  MOD_RES (1)..(1): N-terminal acetylation
  MOD_RES (21)..(21): C-terminal amidation
GYASWPWFVQLHVHKRSWEMA

SEQ ID NO: 2123 - protein, 21 aa, Artificial Sequence
  Synthetic peptide
  MOD_RES (1)..(1): N-terminal acetylation
  MOD_RES (21)..(21): C-terminal amidation
GYASFPWWVQLHVHKRSWEMA

SEQ ID NO: 2124 - protein, 21 aa, Artificial Sequence
  Synthetic peptide
  MOD_RES (1)..(1): N-terminal acetylation
  MOD_RES (21)..(21): C-terminal amidation
GYASFPWFVQWHVHKRSWEMA

SEQ ID NO: 2125 - protein, 21 aa, Artificial Sequence
  Synthetic peptide
  MOD_RES (1)..(1): N-terminal acetylation
  MOD_RES (20)..(20): C-terminal amidation
GYASFPWFVQLHVHKRSWEMW

SEQ ID NO: 2126 - protein, 21 aa, Artificial Sequence
  Synthetic peptide
  MOD_RES (1)..(1): N-terminal acetylation
  MOD_RES (21)..(21): C-terminal amidation
GYASFPWYVQLHVHKRSWEMA

SEQ ID NO: 2127 - protein, 30 aa, Artificial Sequence
  Synthetic peptide
  MOD_RES (1)..(1): N-terminal acetylation
  MOD_RES (30)..(30): C-terminal amidation
MKSRSLGLAYFAKHSSLEVLQTRKVAAPYY

SEQ ID NO: 2128 - protein, 29 aa, Artificial Sequence
  Synthetic peptide
  MOD_RES (1)..(1): N-terminal acetylation
  MOD_RES (29)..(29): C-terminal amidation
KKSGYASFPLAVQLHVSKRSKEMALARKK

SEQ ID NO: 2129 - protein, 29 aa, Artificial Sequence
  Synthetic peptide
  MOD_RES (1)..(1): N-terminal acetylation
  MOD_RES (29)..(29): C-terminal amidation
KKPLAVQLHVSKRSKEMALARLYYKTSKK

SEQ ID NO: 2130 - protein, 24 aa, Artificial Sequence
  Synthetic peptide
  MOD_RES (1)..(1): N-terminal acetylation
  MOD_RES (24)..(24): C-terminal amidation
ASFPLAVQLHVSKRSKEMALARLY

SEQ ID NO: 2131 - protein, 31 aa, Artificial Sequence
  Synthetic peptide
  MOD_RES (1)..(1): N-terminal acetylation
  MOD_RES (31)..(31): C-terminal amidation
SGAASFPLAVQLHVSKRSKEMALARLYYKTS

SEQ ID NO: 2132 - protein, 31 aa, Artificial Sequence
  Synthetic peptide
  MOD_RES (1)..(1): N-terminal acetylation
  MOD_RES (31)..(31): C-terminal amidation
SGYASAPLAVQLHVSKRSKEMALARLYYKTS

SEQ ID NO: 2133 - protein, 31 aa, Artificial Sequence
  Synthetic peptide
  MOD_RES (1)..(1): N-terminal acetylation
  MOD_RES (31)..(31): C-terminal amidation
SGYASFPLAAQLHVSKRSKEMALARLYYKTS

SEQ ID NO: 2134 - protein, 31 aa, Artificial Sequence
  Synthetic peptide
  MOD_RES (1)..(1): N-terminal acetylation
  MOD_RES (31)..(31): C-terminal amidation
SGYASFPLAVQLAVSKRSKEMALARLYYKTS

SEQ ID NO: 2135 - protein, 31 aa, Artificial Sequence
  Synthetic peptide
  MOD_RES (1)..(1): N-terminal acetylation
  MOD_RES (31)..(31): C-terminal amidation
SGYASFPLAVQLHASKRSKEMALARLYYKTS

SEQ ID NO: 2136 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSARSKEMALARLYYKTS

SEQ ID NO: 2137 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKASKEMALARLYYKTS

SEQ ID NO: 2138 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEAALARLYYKTS

SEQ ID NO: 2139 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMAAARLYYKTS

SEQ ID NO: 2140 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLAYKTS

SEQ ID NO: 2141 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYAKTS

SEQ ID NO: 2142 - protein, 33 aa, Artificial Sequence
  Synthetic peptide
GSSGYASFPLAVQLHVSKRSKEMALARLYYKTS

SEQ ID NO: 2143 - protein, 21 aa, Artificial Sequence
  Synthetic peptide
  MOD_RES (1)..(1): N-terminal acetylation
  MOD_RES (21)..(21): C-terminal amidation
GYWSFPHAVWHHVSKRSKEMA

SEQ ID NO: 2144 - protein, 21 aa, Artificial Sequence
  Synthetic peptide
  MOD_RES (1)..(1): N-terminal acetylation
  MOD_RES (21)..(21): C-terminal amidation
GYASFWQAVQLHVWKRSKEIA

SEQ ID NO: 2145 - protein, 21 aa, Artificial Sequence
  Synthetic peptide
  MOD_RES (1)..(1): N-terminal acetylation
  MOD_RES (21)..(21): C-terminal amidation
GYASFPLIVWLHVSKRSKEMA

SEQ ID NO: 2146 - protein, 21 aa, Artificial Sequence
  Synthetic peptide
  MOD_RES (1)..(1): N-terminal acetylation
  MOD_RES (21)..(21): C-terminal amidation
GYASFWQAVQLHVSKRSKEIA

SEQ ID NO: 2147 - protein, 21 aa, Artificial Sequence
  Synthetic peptide
  MOD_RES (1)..(1): N-terminal acetylation
  MOD_RES (21)..(21): C-terminal amidation
GYASFPAFVQLHVHKRSWEMA

SEQ ID NO: 2148 - protein, 21 aa, Artificial Sequence
  Synthetic peptide
  MOD_RES (1)..(1): N-terminal acetylation
  MOD_RES (21)..(21): C-terminal amidation
GYASFPWFVQAHVHKRSWEMA

SEQ ID NO: 2149 - protein, 21 aa, Artificial Sequence
  Synthetic peptide
  MOD_RES (1)..(1): N-terminal acetylation
  MOD_RES (21)..(21): C-terminal amidation
GYASFPWFVQLHAHKRSWEMA

SEQ ID NO: 2150 - protein, 21 aa, Artificial Sequence
  Synthetic peptide
  MOD_RES (1)..(1): N-terminal acetylation
  MOD_RES (21)..(21): C-terminal amidation
GYASFPWFVQLHVAKRSWEMA

SEQ ID NO: 2151 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWAMA

SEQ ID NO: 2152 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEAA

SEQ ID NO: 2153 - protein, 21 aa, Artificial Sequence
  Synthetic peptide
  MOD_RES (1)..(1): N-terminal acetylation
  MOD_RES (21)..(21): C-terminal amidation
GYASFCWFVQLHVHKRSWEMA

SEQ ID NO: 2154 - protein, 21 aa, Artificial Sequence
  Synthetic peptide
  MOD_RES (1)..(1): N-terminal acetylation
  MOD_RES (21)..(21): C-terminal amidation
GYASFPWFVQLCVHKRSWEMA

SEQ ID NO: 2155 - protein, 21 aa, Artificial Sequence
  Synthetic peptide
  MOD_RES (1)..(1): N-terminal acetylation
  MOD_RES (21)..(21): C-terminal amidation
GDASFPWFVQLHVHKRSWEMA

SEQ ID NO: 2156 - protein, 21 aa, Artificial Sequence
  Synthetic peptide
  MOD_RES (1)..(1): N-terminal acetylation
  MOD_RES (21)..(21): C-terminal amidation
GYDSFPWFVQLHVHKRSWEMA

SEQ ID NO: 2157 - protein, 21 aa, Artificial Sequence
  Synthetic peptide
  MOD_RES (1)..(1): N-terminal acetylation
  MOD_RES (21)..(21): C-terminal amidation
GYADFPWFVQLHVHKRSWEMA

SEQ ID NO: 2158 - protein, 21 aa, Artificial Sequence
  Synthetic peptide
  MOD_RES (1)..(1): N-terminal acetylation
  MOD_RES (21)..(21): C-terminal amidation
GYASDPWFVQLHVHKRSWEMA

SEQ ID NO: 2159 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWDMA

SEQ ID NO: 2160 - protein, 21 aa, Artificial Sequence
  Synthetic peptide
  MOD_RES (1)..(1): N-terminal acetylation
  MOD_RES (21)..(21): C-terminal amidation
GYESFPWFVQLHVHKRSWEMA

SEQ ID NO: 2161 - protein, 21 aa, Artificial Sequence
  Synthetic peptide
  MOD_RES (1)..(1): N-terminal acetylation
  MOD_RES (21)..(21): C-terminal amidation
GYAEFPWFVQLHVHKRSWEMA

SEQ ID NO: 2162 - protein, 21 aa, Artificial Sequence
  Synthetic peptide
  MOD_RES (1)..(1): N-terminal acetylation
  MOD_RES (21)..(21): C-terminal amidation
FYASFPWFVQLHVHKRSWEMA

SEQ ID NO: 2163 - protein, 21 aa, Artificial Sequence
  Synthetic peptide
  MOD_RES (1)..(1): N-terminal acetylation
  MOD_RES (21)..(21): C-terminal amidation
GFASFPWFVQLHVHKRSWEMA

SEQ ID NO: 2164 - protein, 21 aa, Artificial Sequence
  Synthetic peptide
  MOD_RES (1)..(1): N-terminal acetylation
  MOD_RES (21)..(21): C-terminal amidation
GYFSFPWFVQLHVHKRSWEMA

SEQ ID NO: 2165 - protein, 21 aa, Artificial Sequence
  Synthetic peptide
  MOD_RES (1)..(1): N-terminal acetylation
  MOD_RES (21)..(21): C-terminal amidation
GYAFFPWFVQLHVHKRSWEMA

SEQ ID NO: 2166 - protein, 21 aa, Artificial Sequence
  Synthetic peptide
  MOD_RES (1)..(1): N-terminal acetylation
  MOD_RES (21)..(21): C-terminal amidation
GYASFPFFVQLHVHKRSWEMA

SEQ ID NO: 2167 - protein, 21 aa, Artificial Sequence
  Synthetic peptide
  MOD_RES (1)..(1): N-terminal acetylation
  MOD_RES (21)..(21): C-terminal amidation
GYASFPWFFQLHVHKRSWEMA

SEQ ID NO: 2168 - protein, 21 aa, Artificial Sequence
  Synthetic peptide
  MOD_RES (1)..(1): N-terminal acetylation
  MOD_RES (21)..(21): C-terminal amidation
GYASFPWFVFLHVHKRSWEMA

SEQ ID NO: 2169 - protein, 21 aa, Artificial Sequence
  Synthetic peptide
  MOD_RES (1)..(1): N-terminal acetylation
  MOD_RES (21)..(21): C-terminal amidation
GYASFPWFVQLHFHKRSWEMA

SEQ ID NO: 2170 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKFSWEMA

SEQ ID NO: 2171 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRFWEMA

SEQ ID NO: 2172 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSFEMA

SEQ ID NO: 2173 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWFMA

SEQ ID NO: 2174 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEFA

SEQ ID NO: 2175 - protein, 21 aa, Artificial Sequence
  Synthetic peptide
  MOD_RES (1)..(1): N-terminal acetylation
  MOD_RES (21)..(21): C-terminal amidation
GYASGPWFVQLHVHKRSWEMA

SEQ ID NO: 2176 - protein, 21 aa, Artificial Sequence
  Synthetic peptide
  MOD_RES (1)..(1): N-terminal acetylation
  MOD_RES (21)..(21): C-terminal amidation
GYASFPGFVQLHVHKRSWEMA

SEQ ID NO: 2177 - protein, 21 aa, Artificial Sequence
  Synthetic peptide
  MOD_RES (1)..(1): N-terminal acetylation
  MOD_RES (21)..(21): C-terminal amidation
GYASFPWGVQLHVHKRSWEMA

SEQ ID NO: 2178 - protein, 21 aa, Artificial Sequence
  Synthetic peptide
  MOD_RES (1)..(1): N-terminal acetylation
  MOD_RES (21)..(21): C-terminal amidation
GYASFPWFGQLHVHKRSWEMA

SEQ ID NO: 2179 - protein, 21 aa, Artificial Sequence
  Synthetic peptide
  MOD_RES (1)..(1): N-terminal acetylation
  MOD_RES (21)..(21): C-terminal amidation
GYASFPWFVGLHVHKRSWEMA

SEQ ID NO: 2180 - protein, 21 aa, Artificial Sequence
  Synthetic peptide
  MOD_RES (1)..(1): N-terminal acetylation
  MOD_RES (21)..(21): C-terminal amidation
GYASFPWFVQGHVHKRSWEMA

SEQ ID NO: 2181 - protein, 21 aa, Artificial Sequence
  Synthetic peptide
  MOD_RES (1)..(1): N-terminal acetylation
  MOD_RES (21)..(21): C-terminal amidation
GYASFPWFVQLHGHKRSWEMA

SEQ ID NO: 2182 - protein, 21 aa, Artificial Sequence
  Synthetic peptide
  MOD_RES (1)..(1): N-terminal acetylation
  MOD_RES (21)..(21): C-terminal amidation
GYASFPWFVQLHVGKRSWEMA

SEQ ID NO: 2183 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWGMA

SEQ ID NO: 2184 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEGA

SEQ ID NO: 2185 - protein, 21 aa, Artificial Sequence
  Synthetic peptide
  MOD_RES (1)..(1): N-terminal acetylation
  MOD_RES (21)..(21): C-terminal amidation
GHASFPWFVQLHVHKRSWEMA

SEQ ID NO: 2186 - protein, 21 aa, Artificial Sequence
  Synthetic peptide
  MOD_RES (1)..(1): N-terminal acetylation
  MOD_RES (21)..(21): C-terminal amidation
GYASFPHFVQLHVHKRSWEMA

SEQ ID NO: 2187 - protein, 21 aa, Artificial Sequence
  Synthetic peptide
  MOD_RES (1)..(1): N-terminal acetylation
  MOD_RES (21)..(21): C-terminal amidation
GYASFPWFHQLHVHKRSWEMA

SEQ ID NO: 2188 - protein, 21 aa, Artificial Sequence
  Synthetic peptide
  MOD_RES (1)..(1): N-terminal acetylation
  MOD_RES (21)..(21): C-terminal amidation
GYASFPWFVHLHVHKRSWEMA

SEQ ID NO: 2189 - protein, 21 aa, Artificial Sequence
  Synthetic peptide
  MOD_RES (1)..(1): N-terminal acetylation
  MOD_RES (21)..(21): C-terminal amidation
GYASFPWFVQLHHHKRSWEMA

SEQ ID NO: 2190 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEHA

SEQ ID NO: 2191 - protein, 21 aa, Artificial Sequence
  Synthetic peptide
  MOD_RES (1)..(1): N-terminal acetylation
  MOD_RES (21)..(21): C-terminal amidation
IYASFPWFVQLHVHKRSWEMA

SEQ ID NO: 2192 - protein, 21 aa, Artificial Sequence
  Synthetic peptide
  MOD_RES (1)..(1): N-terminal acetylation
  MOD_RES (21)..(21): C-terminal amidation
GYASIPWFVQLHVHKRSWEMA

SEQ ID NO: 2193 - protein, 21 aa, Artificial Sequence
  Synthetic peptide
  MOD_RES (1)..(1): N-terminal acetylation
  MOD_RES (21)..(21): C-terminal amidation
GYASFPIFVQLHVHKRSWEMA

SEQ ID NO: 2194 - protein, 21 aa, Artificial Sequence
  Synthetic peptide
  MOD_RES (1)..(1): N-terminal acetylation
  MOD_RES (21)..(21): C-terminal amidation
GYASFPWFIQLHVHKRSWEMA

SEQ ID NO: 2195 - protein, 21 aa, Artificial Sequence
  Synthetic peptide
  MOD_RES (1)..(1): N-terminal acetylation
  MOD_RES (21)..(21): C-terminal amidation
GYASFPWFVILHVHKRSWEMA

SEQ ID NO: 2196 - protein, 21 aa, Artificial Sequence
  Synthetic peptide
  MOD_RES (1)..(1): N-terminal acetylation
  MOD_RES (21)..(21): C-terminal amidation
GYASFPWFVQLIVHKRSWEMA

SEQ ID NO: 2197 - protein, 21 aa, Artificial Sequence
  Synthetic peptide
  MOD_RES (1)..(1): N-terminal acetylation
  MOD_RES (21)..(21): C-terminal amidation
GYASFKWFVQLHVHKRSWEMA

SEQ ID NO: 2198 - protein, 21 aa, Artificial Sequence
  Synthetic peptide
  MOD_RES (1)..(1): N-terminal acetylation
  MOD_RES (21)..(21): C-terminal amidation
GYASFPKFVQLHVHKRSWEMA

SEQ ID NO: 2199 - protein, 21 aa, Artificial Sequence
  Synthetic peptide
  MOD_RES (1)..(1): N-terminal acetylation
  MOD_RES (21)..(21): C-terminal amidation
GYASFPWFVQLKVHKRSWEMA

SEQ ID NO: 2200 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSKEMA

SEQ ID NO: 2201 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEKA

SEQ ID NO: 2202 - protein, 21 aa, Artificial Sequence
  Synthetic peptide
  MOD_RES (1)..(1): N-terminal acetylation
  MOD_RES (21)..(21): C-terminal amidation
GYASLPWFVQLHVHKRSWEMA

SEQ ID NO: 2203 - protein, 21 aa, Artificial Sequence
  Synthetic peptide
  MOD_RES (1)..(1): N-terminal acetylation
  MOD_RES (21)..(21): C-terminal amidation
GYASFPLFVQLHVHKRSWEMA

SEQ ID NO: 2204 - protein, 21 aa, Artificial Sequence
  Synthetic peptide
  MOD_RES (1)..(1): N-terminal acetylation
  MOD_RES (21)..(21): C-terminal amidation
GYASFPWLVQLHVHKRSWEMA

SEQ ID NO: 2205 - protein, 21 aa, Artificial Sequence
  Synthetic peptide
  MOD_RES (1)..(1): N-terminal acetylation
  MOD_RES (21)..(21): C-terminal amidation
GYASFPWFLQLHVHKRSWEMA

SEQ ID NO: 2206 - protein, 21 aa, Artificial Sequence
  Synthetic peptide
  MOD_RES (1)..(1): N-terminal acetylation
  MOD_RES (21)..(21): C-terminal amidation
GYASFPWFVQLLVHKRSWEMA

SEQ ID NO: 2207 - protein, 21 aa, Artificial Sequence
  Synthetic peptide
  MOD_RES (1)..(1): N-terminal acetylation
  MOD_RES (21)..(21): C-terminal amidation
GYASFPWFVQLHLHKRSWEMA

SEQ ID NO: 2208 - protein, 21 aa, Artificial Sequence
  Synthetic peptide
  MOD_RES (1)..(1): N-terminal acetylation
  MOD_RES (21)..(21): C-terminal amidation
GYASFPWFVQLHVLKRSWEMA

SEQ ID NO: 2209 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSLEMA

SEQ ID NO: 2210 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWLMA

SEQ ID NO: 2211 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWELA

SEQ ID NO: 2212 - protein, 21 aa, Artificial Sequence
  Synthetic peptide
  MOD_RES (1)..(1): N-terminal acetylation
  MOD_RES (21)..(21): C-terminal amidation
GMASFPWFVQLHVHKRSWEMA

SEQ ID NO: 2213 - protein, 21 aa, Artificial Sequence
  Synthetic peptide
  MOD_RES (1)..(1): N-terminal acetylation
  MOD_RES (21)..(21): C-terminal amidation
GYASMPWFVQLHVHKRSWEMA

SEQ ID NO: 2214 - protein, 21 aa, Artificial Sequence
  Synthetic peptide
  MOD_RES (1)..(1): N-terminal acetylation
  MOD_RES (21)..(21): C-terminal amidation
GYASFPWMVQLHVHKRSWEMA

SEQ ID NO: 2215 - protein, 21 aa, Artificial Sequence
  Synthetic peptide
  MOD_RES (1)..(1): N-terminal acetylation
  MOD_RES (21)..(21): C-terminal amidation
GYASFPWFMQLHVHKRSWEMA

SEQ ID NO: 2216 - protein, 21 aa, Artificial Sequence
  Synthetic peptide
  MOD_RES (1)..(1): N-terminal acetylation
  MOD_RES (21)..(21): C-terminal amidation
GYASFPWFVMLHVHKRSWEMA

SEQ ID NO: 2217 - protein, 21 aa, Artificial Sequence
  Synthetic peptide
  MOD_RES (1)..(1): N-terminal acetylation
  MOD_RES (20)..(20): C-terminal amidation
  MOD_RES (21)..(21): C-terminal amidation
GYASFPWFVQLHMHKRSWEMA

SEQ ID NO: 2218 - protein, 21 aa, Artificial Sequence
  Synthetic peptide
  MOD_RES (1)..(1): N-terminal acetylation
  MOD_RES (21)..(21): C-terminal amidation
GYASFPWFVQLHVMKRSWEMA

SEQ ID NO: 2219 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSMEMA

SEQ ID NO: 2220 - protein, 21 aa, Artificial Sequence
  Synthetic peptide
  MOD_RES (1)..(1): N-terminal acetylation
  MOD_RES (21)..(21): C-terminal amidation
GNASFPWFVQLHVHKRSWEMA

SEQ ID NO: 2221 - protein, 21 aa, Artificial Sequence
  Synthetic peptide
  MOD_RES (1)..(1): N-terminal acetylation
  MOD_RES (21)..(21): C-terminal amidation
GYNSFPWFVQLHVHKRSWEMA

SEQ ID NO: 2222 - protein, 21 aa, Artificial Sequence
  Synthetic peptide
  MOD_RES (1)..(1): N-terminal acetylation
  MOD_RES (21)..(21): C-terminal amidation
GYASNPWFVQLHVHKRSWEMA

SEQ ID NO: 2223 - protein, 21 aa, Artificial Sequence
  Synthetic peptide
  MOD_RES (1)..(1): N-terminal acetylation
  MOD_RES (21)..(21): C-terminal amidation
GYASFPNFVQLHVHKRSWEMA

SEQ ID NO: 2224 - protein, 21 aa, Artificial Sequence
  Synthetic peptide
  MOD_RES (1)..(1): N-terminal acetylation
  MOD_RES (21)..(21): C-terminal amidation
GYASFPWNVQLHVHKRSWEMA

SEQ ID NO: 2225 - protein, 21 aa, Artificial Sequence
  Synthetic peptide
  MOD_RES (1)..(1): N-terminal acetylation
  MOD_RES (21)..(21): C-terminal amidation
GYASFPWFVNLHVHKRSWEMA

SEQ ID NO: 2226 - protein, 21 aa, Artificial Sequence
  Synthetic peptide
  MOD_RES (1)..(1): N-terminal acetylation
  MOD_RES (21)..(21): C-terminal amidation
GYASFPWFVQNHVHKRSWEMA

SEQ ID NO: 2227 - protein, 21 aa, Artificial Sequence
  Synthetic peptide
  MOD_RES (1)..(1): N-terminal acetylation
  MOD_RES (21)..(21): C-terminal amidation
GYASFPWFVQLHVNKRSWEMA

SEQ ID NO: 2228 - protein, 21 aa, Artificial Sequence
  Synthetic peptide
  MOD_RES (1)..(1): N-terminal acetylation
  MOD_RES (21)..(21): C-terminal N-methyl
GYASFPWFVQLHVHKRSWNMA

SEQ ID NO: 2229 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWENA

SEQ ID NO: 2230 - protein, 21 aa, Artificial Sequence
  Synthetic peptide
  MOD_RES (1)..(1): N-terminal acetylation
  MOD_RES (21)..(21): C-terminal amidation
GPASFPWFVQLHVHKRSWEMA

SEQ ID NO: 2231 - protein, 21 aa, Artificial Sequence
  Synthetic peptide
  MOD_RES (1)..(1): N-terminal acetylation
  MOD_RES (21)..(21): C-terminal amidation
GYPSFPWFVQLHVHKRSWEMA

SEQ ID NO: 2232 - protein, 21 aa, Artificial Sequence
  Synthetic peptide
  MOD_RES (1)..(1): N-terminal acetylation
  MOD_RES (21)..(21): C-terminal amidation
GYASPPWFVQLHVHKRSWEMA

SEQ ID NO: 2233 - protein, 21 aa, Artificial Sequence
  Synthetic peptide
  MOD_RES (1)..(1): N-terminal acetylation
  MOD_RES (21)..(21): C-terminal amidation
GYASFPWPVQLHVHKRSWEMA

SEQ ID NO: 2234 - protein, 21 aa, Artificial Sequence
  Synthetic peptide
  MOD_RES (1)..(1): N-terminal acetylation
  MOD_RES (21)..(21): C-terminal amidation
GYASFPWFVPLHVHKRSWEMA

SEQ ID NO: 2235 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWPMA

SEQ ID NO: 2236 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMP

SEQ ID NO: 2237 - protein, 21 aa, Artificial Sequence
  Synthetic peptide
  MOD_RES (1)..(1): N-terminal acetylation
  MOD_RES (21)..(21): C-terminal amidation
QYASFPWFVQLHVHKRSWEMA

SEQ ID NO: 2238 - protein, 21 aa, Artificial Sequence
  Synthetic peptide
  MOD_RES (1)..(1): N-terminal acetylation
  MOD_RES (21)..(21): C-terminal amidation
GYQSFPWFVQLHVHKRSWEMA

SEQ ID NO: 2239 - protein, 21 aa, Artificial Sequence
  Synthetic peptide
  MOD_RES (1)..(1): N-terminal acetylation
  MOD_RES (21)..(21): C-terminal amidation
GYAQFPWFVQLHVHKRSWEMA

SEQ ID NO: 2240 - protein, 21 aa, Artificial Sequence
  Synthetic peptide
  MOD_RES (1)..(1): N-terminal acetylation
  MOD_RES (21)..(21): C-terminal amidation
GYASQPWFVQLHVHKRSWEMA

SEQ ID NO: 2241 - protein, 21 aa, Artificial Sequence
  Synthetic peptide
  MOD_RES (1)..(1): N-terminal acetylation
  MOD_RES (21)..(21): C-terminal amidation
GYASFPWQVQLHVHKRSWEMA

SEQ ID NO: 2242 - protein, 21 aa, Artificial Sequence
  Synthetic peptide
  MOD_RES (1)..(1): N-terminal acetylation
  MOD_RES (21)..(21): C-terminal amidation
GYASFPWFVQQHVHKRSWEMA

SEQ ID NO: 2243 - protein, 21 aa, Artificial Sequence
  Synthetic peptide
  MOD_RES (1)..(1): N-terminal acetylation
  MOD_RES (21)..(21): C-terminal amidation
GYASFPWFVQLHVQKRSWEMA

SEQ ID NO: 2244 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSQEMA

SEQ ID NO: 2245 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWQMA

SEQ ID NO: 2246 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEQA

SEQ ID NO: 2247 - protein, 21 aa, Artificial Sequence
  Synthetic peptide
  MOD_RES (1)..(1): N-terminal acetylation
  MOD_RES (21)..(21): C-terminal amidation
GYASFRWFVQLHVHKRSWEMA

SEQ ID NO: 2248 - protein, 21 aa, Artificial Sequence
  Synthetic peptide
  MOD_RES (1)..(1): N-terminal acetylation
  MOD_RES (21)..(21): C-terminal amidation
GYASFPWFVQLRVHKRSWEMA

SEQ ID NO: 2249 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWERA

SEQ ID NO: 2250 - protein, 21 aa, Artificial Sequence
  Synthetic peptide
  MOD_RES (1)..(1): N-terminal acetylation
  MOD_RES (21)..(21): C-terminal amidation
GSASFPWFVQLHVHKRSWEMA

SEQ ID NO: 2251 - protein, 21 aa, Artificial Sequence
  Synthetic peptide
  MOD_RES (1)..(1): N-terminal acetylation
  MOD_RES (21)..(21): C-terminal amidation
GYASSPWFVQLHVHKRSWEMA

SEQ ID NO: 2252 - protein, 21 aa, Artificial Sequence
  Synthetic peptide
  MOD_RES (1)..(1): N-terminal acetylation
  MOD_RES (21)..(21): C-terminal amidation
GYASFPSFVQLHVHKRSWEMA

SEQ ID NO: 2253 - protein, 21 aa, Artificial Sequence
  Synthetic peptide
  MOD_RES (1)..(1): N-terminal acetylation
  MOD_RES (21)..(21): C-terminal amidation
GYASFPWSVQLHVHKRSWEMA

SEQ ID NO: 2254 - protein, 21 aa, Artificial Sequence
  Synthetic peptide
  MOD_RES (1)..(1): N-terminal acetylation
  MOD_RES (21)..(21): C-terminal amidation
GYASFPWFSQLHVHKRSWEMA

SEQ ID NO: 2255 - protein, 21 aa, Artificial Sequence
  Synthetic peptide
  MOD_RES (1)..(1): N-terminal acetylation
  MOD_RES (21)..(21): C-terminal amidation
GYASFPWFVQSHVHKRSWEMA

SEQ ID NO: 2256 - protein, 21 aa, Artificial Sequence
  Synthetic peptide
  MOD_RES (1)..(1): N-terminal acetylation
  MOD_RES (21)..(21): C-terminal amidation
GYASFPWFVQLHSHKRSWEMA

SEQ ID NO: 2257 - protein, 21 aa, Artificial Sequence
  Synthetic peptide
  MOD_RES (1)..(1): N-terminal acetylation
  MOD_RES (21)..(21): C-terminal amidation
GYASFPWFVQLHVSKRSWEMA

SEQ ID NO: 2258 - protein, 21 aa, Artificial Sequence
  Synthetic peptide
  MOD_RES (1)..(1): N-terminal acetylation
  MOD_RES (21)..(21): C-terminal amidation
GTASFPWFVQLHVHKRSWEMA

SEQ ID NO: 2259 - protein, 21 aa, Artificial Sequence
  Synthetic peptide
  MOD_RES (1)..(1): N-terminal acetylation
  MOD_RES (21)..(21): C-terminal amidation
GYASTPWFVQLHVHKRSWEMA

SEQ ID NO: 2260 - protein, 21 aa, Artificial Sequence
  Synthetic peptide
  MOD_RES (1)..(1): N-terminal acetylation
  MOD_RES (21)..(21): C-terminal amidation
GYASFPTFVQLHVHKRSWEMA

SEQ ID NO: 2261 - protein, 21 aa, Artificial Sequence
  Synthetic peptide
  MOD_RES (1)..(1): N-terminal acetylation
  MOD_RES (21)..(21): C-terminal amidation
GYASFPWTVQLHVHKRSWEMA

SEQ ID NO: 2262 - protein, 21 aa, Artificial Sequence
  Synthetic peptide
  MOD_RES (1)..(1): N-terminal acetylation
  MOD_RES (21)..(21): C-terminal amidation
GYASFPWFTQLHVHKRSWEMA

SEQ ID NO: 2263 - protein, 21 aa, Artificial Sequence
  Synthetic peptide
  MOD_RES (1)..(1): N-terminal acetylation
  MOD_RES (21)..(21): C-terminal amidation
GYASFPWFVTLHVHKRSWEMA

SEQ ID NO: 2264 - protein, 21 aa, Artificial Sequence
  Synthetic peptide
  MOD_RES (1)..(1): N-terminal acetylation
  MOD_RES (21)..(21): C-terminal amidation
GYASFPWFVQTHVHKRSWEMA

SEQ ID NO: 2265 - protein, 21 aa, Artificial Sequence
  Synthetic peptide
  MOD_RES (1)..(1): N-terminal acetylation
  MOD_RES (21)..(21): C-terminal amidation
GYASFPWFVQLHVTKRSWEMA

SEQ ID NO: 2266 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMT

SEQ ID NO: 2267 - protein, 21 aa, Artificial Sequence
  Synthetic peptide
  MOD_RES (1)..(1): N-terminal acetylation
  MOD_RES (21)..(21): C-terminal amidation
GYAVFPWFVQLHVHKRSWEMA

SEQ ID NO: 2268 - protein, 21 aa, Artificial Sequence
  Synthetic peptide
  MOD_RES (1)..(1): N-terminal acetylation
  MOD_RES (21)..(21): C-terminal amidation
GYASVPWFVQLHVHKRSWEMA

SEQ ID NO: 2269 - protein, 21 aa, Artificial Sequence
  Synthetic peptide
  MOD_RES (1)..(1): N-terminal acetylation
  MOD_RES (21)..(21): C-terminal amidation
GYASFPWFVVLHVHKRSWEMA

SEQ ID NO: 2270 - protein, 21 aa, Artificial Sequence
  Synthetic peptide
  MOD_RES (1)..(1): N-terminal acetylation
  MOD_RES (21)..(21): C-terminal amidation
GYASFPWFVQLHVVKRSWEMA

SEQ ID NO: 2271 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSVEMA

SEQ ID NO: 2272 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWVMA

SEQ ID NO: 2273 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEVA

SEQ ID NO: 2274 - protein, 21 aa, Artificial Sequence
  Synthetic peptide
  MOD_RES (1)..(1): N-terminal acetylation
  MOD_RES (21)..(21): C-terminal amidation
WYASFPWFVQLHVHKRSWEMA

SEQ ID NO: 2275 - protein, 21 aa, Artificial Sequence
  Synthetic peptide
  MOD_RES (1)..(1): N-terminal acetylation
  MOD_RES (21)..(21): C-terminal amidation
GYAWFPWFVQLHVHKRSWEMA

SEQ ID NO: 2276 - protein, 21 aa, Artificial Sequence
  Synthetic peptide
  MOD_RES (1)..(1): N-terminal acetylation
  MOD_RES (21)..(21): C-terminal amidation
GYASFPWFWQLHVHKRSWEMA

SEQ ID NO: 2277 - protein, 21 aa, Artificial Sequence
  Synthetic peptide
  MOD_RES (1)..(1): N-terminal acetylation
  MOD_RES (21)..(21): C-terminal amidation
GYASFPWFVWLHVHKRSWEMA

SEQ ID NO: 2278 - protein, 21 aa, Artificial Sequence
  Synthetic peptide
  MOD_RES (1)..(1): N-terminal acetylation
  MOD_RES (21)..(21): C-terminal amidation
GYASFPWFVQLHWHKRSWEMA

SEQ ID NO: 2279 - protein, 21 aa, Artificial Sequence
  Synthetic peptide
  MOD_RES (1)..(1): N-terminal acetylation
  MOD_RES (21)..(21): C-terminal amidation
GYASFPWFVQLHVWKRSWEMA

SEQ ID NO: 2280 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRWWEMA

SEQ ID NO: 2281 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWWMA

SEQ ID NO: 2282 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEWA

SEQ ID NO: 2283 - protein, 21 aa, Artificial Sequence
  Synthetic peptide
  MOD_RES (1)..(1): N-terminal acetylation
  MOD_RES (21)..(21): C-terminal amidation
GYYSFPWFVQLHVHKRSWEMA

SEQ ID NO: 2284 - protein, 21 aa, Artificial Sequence
  Synthetic peptide
  MOD_RES (1)..(1): N-terminal acetylation
  MOD_RES (20)..(20): C-terminal amidation
GYAYFPWFVQLHVHKRSWEMA

SEQ ID NO: 2285 - protein, 21 aa, Artificial Sequence
  Synthetic peptide
  MOD_RES (1)..(1): N-terminal acytlation
  MOD_RES (21)..(21): C-terminal amidation
GYASYPWFVQLHVHKRSWEMA

SEQ ID NO: 2286 - protein, 21 aa, Artificial Sequence
  Synthetic peptide
  MOD_RES (1)..(1): N-terminal acetylation
  MOD_RES (21)..(21): C-terminal amidation
GYASFPYFVQLHVHKRSWEMA

SEQ ID NO: 2287 - protein, 21 aa, Artificial Sequence
  Synthetic peptide
  MOD_RES (1)..(1): N-terminal acetylation
  MOD_RES (21)..(21): C-terminal amidation
GYASFPWFYQLHVHKRSWEMA

SEQ ID NO: 2288 - protein, 21 aa, Artificial Sequence
  Synthetic peptide
  MOD_RES (1)..(1): N-terminal acetylation
  MOD_RES (21)..(21): C-terminal amidation
GYASFPWFVYLHVHKRSWEMA

SEQ ID NO: 2289 - protein, 21 aa, Artificial Sequence
  Synthetic peptide
  MOD_RES (1)..(1): N-terminal acetylation
  MOD_RES (21)..(21): C-terminal amidation
GYASFPWFVQYHVHKRSWEMA

SEQ ID NO: 2290 - protein, 21 aa, Artificial Sequence
  Synthetic peptide
  MOD_RES (1)..(1): N-terminal acetylation
  MOD_RES (21)..(21): C-terminal amidation
GYASFPWFVQLHYHKRSWEMA

SEQ ID NO: 2291 - protein, 21 aa, Artificial Sequence
  Synthetic peptide
  MOD_RES (1)..(1): N-terminal acetylation
  MOD_RES (21)..(21): C-terminal amidation
GYASFPWFVQLHVYKRSWEMA

SEQ ID NO: 2292 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRYWEMA

SEQ ID NO: 2293 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSYEMA

SEQ ID NO: 2294 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWYMA

SEQ ID NO: 2295 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEYA

SEQ ID NO: 2296 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMY

SEQ ID NO: 2297 - protein, 30 aa, Artificial Sequence
  Synthetic peptide
  MOD_RES (1)..(1): N-terminal acetylation
  MOD_RES (21)..(21): C-terminal amidation
KMQLRVYASTAHSRYLLGSSLFPKYAEVKA

SEQ ID NO: 2298 - protein, 32 aa, Artificial Sequence
  Synthetic peptide
  MOD_RES (1)..(1): N-terminal acetylation
  MOD_RES (21)..(21): C-terminal amidation
KKSGYASFPLAVQLHVSKRSKEMALARLYYKK

SEQ ID NO: 2299 - protein, 26 aa, Artificial Sequence
  Synthetic peptide
  MOD_RES (1)..(1): N-terminal acetylation
  MOD_RES (21)..(21): C-terminal amidation
KKSGYASFPLAVQLHVSKRSKEMAKK

SEQ ID NO: 2300 - protein, 23 aa, Artificial Sequence
  Synthetic peptide
  MOD_RES (1)..(1): N-terminal acetylation
  MOD_RES (21)..(21): C-terminal amidation
KKSGYASFPLAVQLHVSKRSKKK

SEQ ID NO: 2301 - protein, 26 aa, Artificial Sequence
  Synthetic peptide
  MOD_RES (1)..(1): N-terminal acetylation
  MOD_RES (26)..(26): C-terminal amidation
KKVQLHVSKRSKEMALARLYYKTSKK

SEQ ID NO: 2302 - protein, 23 aa, Artificial Sequence
  Synthetic peptide
  MOD_RES (1)..(1): N-terminal acetylation
  MOD_RES (23)..(23): C-terminal amidation
KKHVSKRSKEMALARLYYKTSKK

SEQ ID NO: 2303 - protein, 24 aa, Artificial Sequence
  Synthetic peptide
  MOD_RES (1)..(1): N-terminal acetylation
  MOD_RES (24)..(24): C-terminal amidation
KKGYASFPLAVQLHVSKRSKEMKK

SEQ ID NO: 2304 - protein, 24 aa, Artificial Sequence
  Synthetic peptide
  MOD_RES (1)..(1): N-terminal acetylation
  MOD_RES (24)..(24): C-terminal amidation
KKYASFPLAVQLHVSKRSKEMAKK

SEQ ID NO: 2305 - protein, 24 aa, Artificial Sequence
  Synthetic peptide
  MOD_RES (1)..(1): N-terminal acetylation
  MOD_RES (24)..(24): C-terminal amidation
KKVQLHVSKRSKEMALARLYYKKK

SEQ ID NO: 2306 - protein, 24 aa, Artificial Sequence
  Synthetic peptide
  MOD_RES (1)..(1): N-terminal acetylation
  MOD_RES (24)..(24): C-terminal amidation
KKQLHVSKRSKEMALARLYYKTKK

SEQ ID NO: 2307 - protein, 24 aa, Artificial Sequence
  Synthetic peptide
  MOD_RES (1)..(1): N-terminal acetylation
  MOD_RES (24)..(24): C-terminal amidation
KKLHVSKRSKEMALARLYYKTSKK

SEQ ID NO: 2308 - protein, 24 aa, Artificial Sequence
  Synthetic peptide
  MOD_RES (1)..(1): N-terminal acetylation
  MOD_RES (24)..(24): C-terminal amidation
KKSGYASFPLAVQLHVSKRSKEKK

SEQ ID NO: 2309 - protein, 19 aa, Artificial Sequence
  Synthetic peptide
  MOD_RES (1)..(1): N-terminal acetylation
  MOD_RES (19)..(19): C-terminal amidation
ASFPLAVQLHVSKRSKEMA

SEQ ID NO: 2310 - protein, 18 aa, Artificial Sequence
  Synthetic peptide
  MOD_RES (1)..(1): N-terminal acetylation
  MOD_RES (18)..(18): C-terminal amidation
SFPLAVQLHVSKRSKEMA

SEQ ID NO: 2311 - protein, 17 aa, Artificial Sequence
  Synthetic peptide
  MOD_RES (1)..(1): N-terminal acetylation
  MOD_RES (17)..(17): C-terminal amidation
FPLAVQLHVSKRSKEMA

SEQ ID NO: 2312 - protein, 18 aa, Artificial Sequence
  Synthetic peptide
  MOD_RES (1)..(1): N-terminal acetylation
  MOD_RES (18)..(18): C-terminal amidation
ASFPLAVQLHVSKRSKEM

SEQ ID NO: 2313 - protein, 17 aa, Artificial Sequence
  Synthetic peptide
  MOD_RES (1)..(1): N-terminal acetylation
  MOD_RES (17)..(17): C-terminal amidation
ASFPLAVQLHVSKRSKE

SEQ ID NO: 2314 - protein, 20 aa, Artificial Sequence
  Synthetic peptide
  MOD_RES (1)..(1): N-terminal acetylation
  MOD_RES (20)..(20): C-terminal amidation
ASFPLAVQLHVSKRSKEMAL

SEQ ID NO: 2315 - protein, 21 aa, Artificial Sequence
  Synthetic peptide
  MOD_RES (1)..(1): N-terminal acetylation
  MOD_RES (21)..(21): C-terminal amidation
ASFPLAVQLHVSKRSKEMALA

SEQ ID NO: 2316 - protein, 22 aa, Artificial Sequence
  Synthetic peptide
  MOD_RES (1)..(1): N-terminal acetylation
  MOD_RES (22)..(22): C-terminal amidation
ASFPLAVQLHVSKRSKEMALAR

SEQ ID NO: 2317 - protein, 23 aa, Artificial Sequence
  Synthetic peptide
  MOD_RES (1)..(1): N-terminal acetylation
  MOD_RES (23)..(23): C-terminal amidation
ASFPLAVQLHVSKRSKEMALARL

SEQ ID NO: 2318 - protein, 20 aa, Artificial Sequence
  Synthetic peptide
  MOD_RES (1)..(1): N-terminal acetylation
  MOD_RES (20)..(20): C-terminal amidation
YASFPLAVQLHVSKRSKEMA

SEQ ID NO: 2319 - protein, 21 aa, Artificial Sequence
  Synthetic peptide
  MOD_RES (1)..(1): N-terminal acetylation
  MOD_RES (21)..(21): C-terminal amidation
GYASFPLAVQLHVSKRSKEMA

SEQ ID NO: 2320 - protein, 21 aa, Artificial Sequence
  Synthetic peptide
  MOD_RES (1)..(1): N-terminal acetylation
  MOD_RES (21)..(21): C-terminal amidation
GYASFALSVQLHVSKRSKEMA

SEQ ID NO: 2321 - protein, 21 aa, Artificial Sequence
  Synthetic peptide
  MOD_RES (1)..(1): N-terminal acetylation
  MOD_RES (21)..(21): C-terminal amidation
GYASFALAVQLHVAKRSKEMA

SEQ ID NO: 2322 - protein, 21 aa, Artificial Sequence
  Synthetic peptide
  MOD_RES (1)..(1): N-terminal acetylation
  MOD_RES (21)..(21): C-terminal amidation
GYASFALAVQLHVMKRSKEMA

SEQ ID NO: 2323 - protein, 19 aa, Artificial Sequence
  Synthetic peptide
  MOD_RES (1)..(1): N-terminal acetylation
  MOD_RES (19)..(19): C-terminal amidation
FPLAVQLHVSKRSKEMALA

SEQ ID NO: 2324 - protein, 14 aa, Artificial Sequence
  Synthetic peptide
  MOD_RES (1)..(1): N-terminal acetylation
  MOD_RES (14)..(14): C-terminal amidation
QLHVSKRSKEMALA

SEQ ID NO: 2325 - protein, 7 aa, Artificial Sequence
  Synthetic peptide
  MOD_RES (1)..(1): N-terminal acetylation
  MOD_RES (7)..(7): C-terminal amidation
SGYASFP

SEQ ID NO: 2326 - protein, 19 aa, Artificial Sequence
  Synthetic peptide
  MOD_RES (1)..(1): N-terminal acetylation
  MOD_RES (19)..(19): C-terminal amidation
LAVQLHVSKRSKEMALARL

SEQ ID NO: 2327 - protein, 21 aa, Artificial Sequence
  Synthetic peptide
  MOD_RES (1)..(1): N-terminal acetylation
  MOD_RES (21)..(21): C-terminal amidation
VYASFFLTVQLHVSKRSKEMA

SEQ ID NO: 2328 - protein, 21 aa, Artificial Sequence
  Synthetic peptide
  MOD_RES (1)..(1): N-terminal acetylation
  MOD_RES (21)..(21): C-terminal amidation
GYWSFPQAVQLHVSKRSKEMA

SEQ ID NO: 2329 - protein, 21 aa, Artificial Sequence
  Synthetic peptide
  MOD_RES (1)..(1): N-terminal acetylation
  MOD_RES (21)..(21): C-terminal amidation
GYASFILAVQLHVSKRSKEMA

SEQ ID NO: 2330 - protein, 21 aa, Artificial Sequence
  Synthetic peptide
  MOD_RES (1)..(1): N-terminal acetylation
  MOD_RES (21)..(21): C-terminal amidation
GYWSFYLAVQLHVSKRSKEMA

SEQ ID NO: 2331 - protein, 21 aa, Artificial Sequence
  Synthetic peptide
  MOD_RES (1)..(1): N-terminal acetylation
  MOD_RES (21)..(21): C-terminal amidation
SYASFFLAVQLHVSKRSEEMA

SEQ ID NO: 2332 - protein, 21 aa, Artificial Sequence
  Synthetic peptide
  MOD_RES (1)..(1): N-terminal acetylation
  MOD_RES (21)..(21): C-terminal amidation
GYASFILAVQLHIIKRSKEMA

SEQ ID NO: 2333 - protein, 21 aa, Artificial Sequence
  Synthetic peptide
  MOD_RES (1)..(1): N-terminal acetylation
  MOD_RES (21)..(21): C-terminal amidation
GMASFFLARDLHWSKVFKEMA

SEQ ID NO: 2334 - protein, 21 aa, Artificial Sequence
  Synthetic peptide
  MOD_RES (1)..(1): N-terminal acetylation
  MOD_RES (21)..(21): C-terminal amidation
EYAQFWLAVQLHVSKRSKEMA

SEQ ID NO: 2335 - protein, 21 aa, Artificial Sequence
  Synthetic peptide
  MOD_RES (1)..(1): N-terminal acetylation
  MOD_RES (21)..(21): C-terminal amidation
GYASFPLIVQLHVSKRSKEMA

SEQ ID NO: 2336 - protein, 21 aa, Artificial Sequence
  Synthetic peptide
  MOD_RES (1)..(1): N-terminal acetylation
  MOD_RES (21)..(21): C-terminal amidation
GYASFPIHVQHHVSKRSKEMA

SEQ ID NO: 2337 - protein, 21 aa, Artificial Sequence
  Synthetic peptide
  MOD_RES (1)..(1): N-terminal acetylation
  MOD_RES (21)..(21): C-terminal amidation
GYASFALMVQLHVSKRSKEMA

SEQ ID NO: 2338 - protein, 21 aa, Artificial Sequence
  Synthetic peptide
  MOD_RES (1)..(1): N-terminal acetylation
  MOD_RES (21)..(21): C-terminal amidation
GYASFHQAVQRHVSKRSKEMA

SEQ ID NO: 2339 - protein, 21 aa, Artificial Sequence
  Synthetic peptide
  MOD_RES (1)..(1): N-terminal acetylation
  MOD_RES (21)..(21): C-terminal amidation
GYASFALMVQHHVSKRSKEMA

SEQ ID NO: 2340 - protein, 21 aa, Artificial Sequence
  Synthetic peptide
  MOD_RES (1)..(1): N-terminal acetylation
  MOD_RES (21)..(21): C-terminal amidation
GYASFSLAVQLHVSKRSKEMA

SEQ ID NO: 2341 - protein, 21 aa, Artificial Sequence
  Synthetic peptide
  MOD_RES (1)..(1): N-terminal acetylation
  MOD_RES (21)..(21): C-terminal amidation
GYHSFKLAVQLHVSKRSKEIA

SEQ ID NO: 2342 - protein, 21 aa, Artificial Sequence
  Synthetic peptide
  MOD_RES (1)..(1): N-terminal acetylation
  MOD_RES (21)..(21): C-terminal amidation
GYASYVLAVQHHVSWRSWEMA

SEQ ID NO: 2343 - protein, 21 aa, Artificial Sequence
  Synthetic peptide
  MOD_RES (1)..(1): N-terminal acetylation
  MOD_RES (21)..(21): C-terminal amidation
HYHSLPKQVQLHVSKRSKEMA

SEQ ID NO: 2344 - protein, 21 aa, Artificial Sequence
  Synthetic peptide
  MOD_RES (1)..(1): N-terminal acetylation
  MOD_RES (21)..(21): C-terminal amidation
GYASFSLAVQLHVHKRSYEMA

SEQ ID NO: 2345 - protein, 21 aa, Artificial Sequence
  Synthetic peptide
  MOD_RES (1)..(1): N-terminal acetylation
  MOD_RES (21)..(21): C-terminal amidation
GYASFELLVQLHVSKRSKEMA

SEQ ID NO: 2346 - protein, 21 aa, Artificial Sequence
  Synthetic peptide
  MOD_RES (1)..(1): N-terminal acetylation
  MOD_RES (21)..(21): C-terminal amidation
SYSSFKLAVQLHVSKRSKEMA

SEQ ID NO: 2347 - protein, 21 aa, Artificial Sequence
  Synthetic peptide
  MOD_RES (1)..(1): N-terminal acetylation
  MOD_RES (21)..(21): C-terminal amidation
GYAWFPLNVWLHVHKRSHEMA

SEQ ID NO: 2348 - protein, 21 aa, Artificial Sequence
  Synthetic peptide
  MOD_RES (1)..(1): N-terminal acetylation
  MOD_RES (21)..(21): C-terminal amidation
GYASFWLSVQTHVSKRSKEMA

SEQ ID NO: 2349 - protein, 21 aa, Artificial Sequence
  Synthetic peptide
  MOD_RES (1)..(1): N-terminal acetylation
  MOD_RES (21)..(21): C-terminal amidation
GYASFPLMVQLHVIKRSKEMA

SEQ ID NO: 2350 - protein, 21 aa, Artificial Sequence
  Synthetic peptide
  MOD_RES (1)..(1): N-terminal acetylation
  MOD_RES (21)..(21): C-terminal amidation
GYWSFNLVVQLHVSKRSKEMA

SEQ ID NO: 2351 - protein, 21 aa, Artificial Sequence
  Synthetic peptide
  MOD_RES (1)..(1): N-terminal acetylation
  MOD_RES (21)..(21): C-terminal amidation
GYASFHLAVQLHVWKRSKEMA

SEQ ID NO: 2352 - protein, 21 aa, Artificial Sequence
  Synthetic peptide
  MOD_RES (1)..(1): N-terminal acetylation
  MOD_RES (21)..(21): C-terminal amidation
GYASFWLVVQLHVSKRSKEMA

SEQ ID NO: 2353 - protein, 21 aa, Artificial Sequence
  Synthetic peptide
  MOD_RES (1)..(1): N-terminal acetylation
  MOD_RES (21)..(21): C-terminal amidation
GYWSFPLAVQLHVWKRSWEMA

SEQ ID NO: 2354 - protein, 21 aa, Artificial Sequence
  Synthetic peptide
  MOD_RES (1)..(1): N-terminal acetylation
  MOD_RES (21)..(21): C-terminal amidation
GYASFPWYVQLHVSKRSKEMA

SEQ ID NO: 2355 - protein, 21 aa, Artificial Sequence
  Synthetic peptide
  MOD_RES (1)..(1): N-terminal acetylation
  MOD_RES (21)..(21): C-terminal amidation
GYTSFQLAVQLHVSKRSKEMA

SEQ ID NO: 2356 - protein, 21 aa, Artificial Sequence
  Synthetic peptide
  MOD_RES (1)..(1): N-terminal acetylation
  MOD_RES (21)..(21): C-terminal amidation
RYASFPLAVYLHVTKRSKEMA

SEQ ID NO: 2357 - protein, 21 aa, Artificial Sequence
  Synthetic peptide
  MOD_RES (1)..(1): N-terminal acetylation
  MOD_RES (21)..(21): C-terminal amidation
GYWSFPLAVQLHVSKRLKEMA

SEQ ID NO: 2358 - protein, 21 aa, Artificial Sequence
  Synthetic peptide
  MOD_RES (1)..(1): N-terminal acetylation
  MOD_RES (21)..(21): C-terminal amidation
GHASFQTAVQQHVSKRSKEMA

SEQ ID NO: 2359 - protein, 11 aa, Artificial Sequence
  Synthetic peptide
  MOD_RES (1)..(1): N-terminal acetylation
  MOD_RES (11)..(11): C-terminal amidation
FHVSKRSKEMA

SEQ ID NO: 2360 - protein, 21 aa, Artificial Sequence
  Synthetic peptide
  MOD_RES (1)..(1): N-terminal acetylation
  MOD_RES (21)..(21): C-terminal amidation
GYASFWHAVQLHVSKRSKEMA

SEQ ID NO: 2361 - protein, 21 aa, Artificial Sequence
  Synthetic peptide
  MOD_RES (1)..(1): N-terminal acetylation
  MOD_RES (21)..(21): C-terminal amidation
GIASFILAVQLHVYKRSKEMA

SEQ ID NO: 2362 - protein, 21 aa, Artificial Sequence
  Synthetic peptide
  MOD_RES (1)..(1): N-terminal acetylation
  MOD_RES (21)..(21): C-terminal amidation
GYTSFMQAVQHHVSKRSKEIA

SEQ ID NO: 2363 - protein, 21 aa, Artificial Sequence
  Synthetic peptide
  MOD_RES (1)..(1): N-terminal acetylation
  MOD_RES (21)..(21): C-terminal amidation
HYHSFYLAVQLHVWERSYEMA

SEQ ID NO: 2364 - protein, 21 aa, Artificial Sequence
  Synthetic peptide
  MOD_RES (1)..(1): N-terminal acetylation
  MOD_RES (21)..(21): C-terminal amidation
GYASFWHAVQHHVTKRSREMA

SEQ ID NO: 2365 - protein, 21 aa, Artificial Sequence
  Synthetic peptide
  MOD_RES (1)..(1): N-terminal acetylation
  MOD_RES (21)..(21): C-terminal amidation
GYASFTLTVQLHVSKRSKEMA

SEQ ID NO: 2366 - protein, 21 aa, Artificial Sequence
  Synthetic peptide
  MOD_RES (1)..(1): N-terminal acetylation
  MOD_RES (21)..(21): C-terminal amidation
GYASFILTVQLHVSKRSKEMA

SEQ ID NO: 2367 - protein, 21 aa, Artificial Sequence
  Synthetic peptide
  MOD_RES (1)..(1): N-terminal acetylation
  MOD_RES (21)..(21): C-terminal amidation
GYASFWLAVQIHVSKRSKEMA

SEQ ID NO: 2368 - protein, 21 aa, Artificial Sequence
  Synthetic peptide
  MOD_RES (1)..(1): N-terminal acetylation
  MOD_RES (21)..(21): C-terminal amidation
GYASFILAVQHHVSKRSKEMA

SEQ ID NO: 2369 - protein, 21 aa, Artificial Sequence
  Synthetic peptide
  MOD_RES (1)..(1): N-terminal acetylation
  MOD_RES (21)..(21): C-terminal amidation
SYASFPPAVMLHVWKRSYEMA

SEQ ID NO: 2370 - protein, 21 aa, Artificial Sequence
  Synthetic peptide
  MOD_RES (1)..(1): N-terminal acetylation
  MOD_RES (21)..(21): C-terminal amidation
GYASFNLAVQLHVSKRSKEMA

SEQ ID NO: 2371 - protein, 21 aa, Artificial Sequence
  Synthetic peptide
  MOD_RES (1)..(1): N-terminal acetylation
  MOD_RES (21)..(21): C-terminal amidation
GYWSFNLAVQLHVSKRSKEMA

SEQ ID NO: 2372 - protein, 21 aa, Artificial Sequence
  Synthetic peptide
  MOD_RES (1)..(1): N-terminal acetylation
  MOD_RES (21)..(21): C-terminal amidation
GYASFFLAVQLHVSKRSKEMA

SEQ ID NO: 2373 - protein, 21 aa, Artificial Sequence
  Synthetic peptide
  MOD_RES (1)..(1): N-terminal acetylation
  MOD_RES (21)..(21): C-terminal amidation
GYASFWLAVQMHVWKRSKEMA

SEQ ID NO: 2374 - protein, 21 aa, Artificial Sequence
  Synthetic peptide
  MOD_RES (1)..(1): N-terminal acetylation
  MOD_RES (21)..(21): C-terminal amidation
GYASFSLAIQLHVSKRSKEMA

SEQ ID NO: 2375 - protein, 21 aa, Artificial Sequence
  Synthetic peptide
  MOD_RES (1)..(1): N-terminal acetylation
  MOD_RES (21)..(21): C-terminal amidation
GAASFPWFVQLHVHKRSWEMA

SEQ ID NO: 2376 - protein, 21 aa, Artificial Sequence
  Synthetic peptide
  MOD_RES (1)..(1): N-terminal acetylation
  MOD_RES (21)..(21): C-terminal amidation
GYASAPWFVQLHVHKRSWEMA

SEQ ID NO: 2377 - protein, 21 aa, Artificial Sequence
  Synthetic peptide
  MOD_RES (1)..(1): N-terminal acetylation
  MOD_RES (21)..(21): C-terminal amidation
GYASFAWFVQLHVHKRSWEMA

SEQ ID NO: 2378 - protein, 21 aa, Artificial Sequence
  Synthetic peptide
  MOD_RES (1)..(1): N-terminal acetylation
  MOD_RES (21)..(21): C-terminal amidation
GYASFPWFAQLHVHKRSWEMA

SEQ ID NO: 2379 - protein, 21 aa, Artificial Sequence
  Synthetic peptide
  MOD_RES (1)..(1): N-terminal acetylation
  MOD_RES (21)..(21): C-terminal amidation
GYASFPWFVQLAVHKRSWEMA

SEQ ID NO: 2380 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHARSWEMA

SEQ ID NO: 2381 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKASWEMA

SEQ ID NO: 2382 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSAEMA

SEQ ID NO: 2383 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHCRSWEMA

SEQ ID NO: 2384 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKCSWEMA

SEQ ID NO: 2385 - protein, 21 aa, Artificial Sequence
  Synthetic peptide
  MOD_RES (1)..(1): N-terminal acetylation
  MOD_RES (21)..(21): C-terminal amidation
GYASFDWFVQLHVHKRSWEMA

SEQ ID NO: 2386 - protein, 21 aa, Artificial Sequence
  Synthetic peptide
  MOD_RES (1)..(1): N-terminal acetylation
  MOD_RES (21)..(21): C-terminal amidation
GYASFPDFVQLHVHKRSWEMA

SEQ ID NO: 2387 - protein, 21 aa, Artificial Sequence
  Synthetic peptide
  MOD_RES (1)..(1): N-terminal acetylation
  MOD_RES (21)..(21): C-terminal amidation
GYASFPWDVQLHVHKRSWEMA

SEQ ID NO: 2388 - protein, 21 aa, Artificial Sequence
  Synthetic peptide
  MOD_RES (1)..(1): N-terminal acetylation
  MOD_RES (21)..(21): C-terminal amidation
GYASFPWFDQLHVHKRSWEMA

SEQ ID NO: 2389 - protein, 21 aa, Artificial Sequence
  Synthetic peptide
  MOD_RES (1)..(1): N-terminal acetylation
  MOD_RES (21)..(21): C-terminal amidation
GYASFPWFVDLHVHKRSWEMA

SEQ ID NO: 2390 - protein, 21 aa, Artificial Sequence
  Synthetic peptide
  MOD_RES (1)..(1): N-terminal acetylation
  MOD_RES (21)..(21): C-terminal amidation
GYASFPWFVQDHVHKRSWEMA

SEQ ID NO: 2391 - protein, 21 aa, Artificial Sequence
  Synthetic peptide
  MOD_RES (1)..(1): N-terminal acetylation
  MOD_RES (21)..(21): C-terminal amidation
GYASFPWFVQLDVHKRSWEMA

SEQ ID NO: 2392 - protein, 21 aa, Artificial Sequence
  Synthetic peptide
  MOD_RES (1)..(1): N-terminal acetylation
  MOD_RES (21)..(21): C-terminal amidation
GYASFPWFVQLHDHKRSWEMA

SEQ ID NO: 2393 - protein, 21 aa, Artificial Sequence
  Synthetic peptide
  MOD_RES (1)..(1): N-terminal acetylation
  MOD_RES (21)..(21): C-terminal amidation
GYASFPWFVQLHVDKRSWEMA

SEQ ID NO: 2394 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHDRSWEMA

SEQ ID NO: 2395 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKDSWEMA

SEQ ID NO: 2396 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRDWEMA

SEQ ID NO: 2397 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSDEMA

SEQ ID NO: 2398 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEDA

SEQ ID NO: 2399 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMD

SEQ ID NO: 2400 - protein, 21 aa, Artificial Sequence
  Synthetic peptide
  MOD_RES (1)..(1): N-terminal acetylation
  MOD_RES (21)..(21): C-terminal amidation
GEASFPWFVQLHVHKRSWEMA

SEQ ID NO: 2401 - protein, 21 aa, Artificial Sequence
  Synthetic peptide
  MOD_RES (17)..(17): Xaa is 2-Amino-isobutyric acid
  MOD_RES (21)..(21): C-terminal amidation
GYASEPWFVQLHVHKRSWEMA

SEQ ID NO: 2402 - protein, 21 aa, Artificial Sequence
  Synthetic peptide
  MOD_RES (1)..(1): N-terminal acetylation
  MOD_RES (21)..(21): C-terminal amidation
GYASFEWFVQLHVHKRSWEMA

SEQ ID NO: 2403 - protein, 21 aa, Artificial Sequence
  Synthetic peptide
  MOD_RES (1)..(1): N-terminal acetylation
  MOD_RES (21)..(21): C-terminal amidation
GYASFPEFVQLHVHKRSWEMA

SEQ ID NO: 2404 - protein, 21 aa, Artificial Sequence
  Synthetic peptide
  MOD_RES (1)..(1): N-terminal acetylation
  MOD_RES (21)..(21): C-terminal amidation
GYASFPWEVQLHVHKRSWEMA

SEQ ID NO: 2405 - protein, 21 aa, Artificial Sequence
  Synthetic peptide
  MOD_RES (1)..(1): N-terminal acetylation
  MOD_RES (21)..(21): C-terminal amidation
GYASFPWFEQLHVHKRSWEMA

SEQ ID NO: 2406 - protein, 21 aa, Artificial Sequence
  Synthetic peptide
  MOD_RES (1)..(1): N-terminal acetylation
  MOD_RES (21)..(21): C-terminal amidation
GYASFPWFVELHVHKRSWEMA

SEQ ID NO: 2407 - protein, 21 aa, Artificial Sequence
  Synthetic peptide
  MOD_RES (1)..(1): N-terminal acetylation
  MOD_RES (21)..(21): C-terminal amidation
GYASFPWFVQEHVHKRSWEMA

SEQ ID NO: 2408 - protein, 21 aa, Artificial Sequence
  Synthetic peptide
  MOD_RES (1)..(1): N-terminal acetylation
  MOD_RES (21)..(21): C-terminal amidation
GYASFPWFVQLEVHKRSWEMA

SEQ ID NO: 2409 - protein, 21 aa, Artificial Sequence
  Synthetic peptide
  MOD_RES (1)..(1): N-terminal acetylation
  MOD_RES (21)..(21): C-terminal amidation
GYASFPWFVQLHEHKRSWEMA

SEQ ID NO: 2410 - protein, 21 aa, Artificial Sequence
  Synthetic peptide
  MOD_RES (1)..(1): N-terminal acetylation
  MOD_RES (21)..(21): C-terminal amidation
GYASFPWFVQLHVEKRSWEMA

SEQ ID NO: 2411 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHERSWEMA

SEQ ID NO: 2412 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKESWEMA

SEQ ID NO: 2413 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKREWEMA

SEQ ID NO: 2414 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSEEMA

SEQ ID NO: 2415 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEEA

SEQ ID NO: 2416 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEME

SEQ ID NO: 2417 - protein, 21 aa, Artificial Sequence
  Synthetic peptide
  MOD_RES (1)..(1): N-terminal acetylation
  MOD_RES (21)..(21): C-terminal amidation
GYASFFWFVQLHVHKRSWEMA

SEQ ID NO: 2418 - protein, 21 aa, Artificial Sequence
  Synthetic peptide
  MOD_RES (1)..(1): N-terminal acetylation
  MOD_RES (21)..(21): C-terminal amidation
GYASFPWFVQLFVHKRSWEMA

SEQ ID NO: 2419 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHFRSWEMA

SEQ ID NO: 2420 - protein, 21 aa, Artificial Sequence
  Synthetic peptide
  MOD_RES (1)..(1): N-terminal acetylation
  MOD_RES (21)..(21): C-terminal amidation
GYASFGWFVQLHVHKRSWEMA

SEQ ID NO: 2421 - protein, 21 aa, Artificial Sequence
  Synthetic peptide
  MOD_RES (1)..(1): N-terminal acetylation
  MOD_RES (21)..(21): C-terminal amidation
GYASFPWFVQLGVHKRSWEMA

SEQ ID NO: 2422 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHGRSWEMA

SEQ ID NO: 2423 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKGSWEMA

SEQ ID NO: 2424 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSGEMA

SEQ ID NO: 2425 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHHRSWEMA

SEQ ID NO: 2426 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKHSWEMA

SEQ ID NO: 2427 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSHEMA

SEQ ID NO: 2428 - protein, 21 aa, Artificial Sequence
  Synthetic peptide
  MOD_RES (1)..(1): N-terminal acetylation
  MOD_RES (21)..(21): C-terminal amidation
GYASFIWFVQLHVHKRSWEMA

SEQ ID NO: 2429 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHIRSWEMA

SEQ ID NO: 2430 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKISWEMA

SEQ ID NO: 2431 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKKSWEMA

SEQ ID NO: 2432 - protein, 21 aa, Artificial Sequence
  Synthetic peptide
  MOD_RES (1)..(1): N-terminal acetylation
  MOD_RES (21)..(21): C-terminal amidation
GYASFLWFVQLHVHKRSWEMA

SEQ ID NO: 2433 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHLRSWEMA

SEQ ID NO: 2434 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKLSWEMA

SEQ ID NO: 2435 - protein, 21 aa, Artificial Sequence
  Synthetic peptide
  MOD_RES (1)..(1): N-terminal acetylation
  MOD_RES (21)..(21): C-terminal amidation
GYASFMWFVQLHVHKRSWEMA

SEQ ID NO: 2436 - protein, 21 aa, Artificial Sequence
  Synthetic peptide
  MOD_RES (1)..(1): N-terminal acetylation
  MOD_RES (21)..(21): C-terminal amidation
GYASFPMFVQLHVHKRSWEMA

SEQ ID NO: 2437 - protein, 21 aa, Artificial Sequence
  Synthetic peptide
  MOD_RES (1)..(1): N-terminal acetylation
  MOD_RES (21)..(21): C-terminal amidation
GYASFPWFVQLMVHKRSWEMA

SEQ ID NO: 2438 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHMRSWEMA

SEQ ID NO: 2439 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKMSWEMA

SEQ ID NO: 2440 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWMMA

SEQ ID NO: 2441 - protein, 21 aa, Artificial Sequence
  Synthetic peptide
  MOD_RES (1)..(1): N-terminal acetylation
  MOD_RES (21)..(21): C-terminal amidation
GYASFNWFVQLHVHKRSWEMA

SEQ ID NO: 2442 - protein, 21 aa, Artificial Sequence
  Synthetic peptide
  MOD_RES (1)..(1): N-terminal acetylation
  MOD_RES (21)..(21): C-terminal amidation
GYASFPWFNQLHVHKRSWEMA

SEQ ID NO: 2443 - protein, 21 aa, Artificial Sequence
  Synthetic peptide
  MOD_RES (1)..(1): N-terminal acetylation
  MOD_RES (21)..(21): C-terminal amidation
GYASFPWFVQLNVHKRSWEMA

SEQ ID NO: 2444 - protein, 21 aa, Artificial Sequence
  Synthetic peptide
  MOD_RES (1)..(1): N-terminal acetylation
  MOD_RES (21)..(21): C-terminal amidation
GYASFPWFVQLHNHKRSWEMA

SEQ ID NO: 2445 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHNRSWEMA

SEQ ID NO: 2446 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKNSWEMA

SEQ ID NO: 2447 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSNEMA

SEQ ID NO: 2448 - protein, 21 aa, Artificial Sequence
  Synthetic peptide
  MOD_RES (1)..(1): N-terminal acetylation
  MOD_RES (21)..(21): C-terminal amidation
GYASFPPFVQLHVHKRSWEMA

SEQ ID NO: 2449 - protein, 21 aa, Artificial Sequence
  Synthetic peptide
  MOD_RES (1)..(1): N-terminal acetylation
  MOD_RES (21)..(21): C-terminal amidation
GYASFPWFPQLHVHKRSWEMA

SEQ ID NO: 2450 - protein, 21 aa, Artificial Sequence
  Synthetic peptide
  MOD_RES (1)..(1): N-terminal acetylation
  MOD_RES (21)..(21): C-terminal amidation
GYASFPWFVQPHVHKRSWEMA

SEQ ID NO: 2451 - protein, 21 aa, Artificial Sequence
  Synthetic peptide
  MOD_RES (1)..(1): N-terminal acetylation
  MOD_RES (21)..(21): C-terminal amidation
GYASFPWFVQLPVHKRSWEMA

SEQ ID NO: 2452 - protein, 21 aa, Artificial Sequence
  Synthetic peptide
  MOD_RES (1)..(1): N-terminal acetylation
  MOD_RES (21)..(21): C-terminal amidation
GYASFPWFVQLHPHKRSWEMA

SEQ ID NO: 2453 - protein, 21 aa, Artificial Sequence
  Synthetic peptide
  MOD_RES (1)..(1): N-terminal acetylation
  MOD_RES (21)..(21): C-terminal amidation
GYASFPWFVQLHVPKRSWEMA

SEQ ID NO: 2454 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHPRSWEMA

SEQ ID NO: 2455 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKPSWEMA

SEQ ID NO: 2456 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRPWEMA

SEQ ID NO: 2457 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSPEMA

SEQ ID NO: 2458 - protein, 21 aa, Artificial Sequence
  Synthetic peptide
  MOD_RES (1)..(1): N-terminal acetylation
  MOD_RES (21)..(21): C-terminal amidation
GQASFPWFVQLHVHKRSWEMA

SEQ ID NO: 2459 - protein, 21 aa, Artificial Sequence
  Synthetic peptide
  MOD_RES (1)..(1): N-terminal acetylation
  MOD_RES (21)..(21): C-terminal amidation
GYASFQWFVQLHVHKRSWEMA

SEQ ID NO: 2460 - protein, 21 aa, Artificial Sequence
  Synthetic peptide
  MOD_RES (1)..(1): N-terminal acetylation
  MOD_RES (21)..(21): C-terminal amidation
GYASFPQFVQLHVHKRSWEMA

SEQ ID NO: 2461 - protein, 21 aa, Artificial Sequence
  Synthetic peptide
  MOD_RES (1)..(1): N-terminal acetylation
  MOD_RES (21)..(21): C-terminal amidation
GYASFPWFQQLHVHKRSWEMA

SEQ ID NO: 2462 - protein, 21 aa, Artificial Sequence
  Synthetic peptide
  MOD_RES (1)..(1): N-terminal acetylation
  MOD_RES (20)..(20): C-terminal amidation
GYASFPWFVQLQVHKRSWEMA

SEQ ID NO: 2463 - protein, 21 aa, Artificial Sequence
  Synthetic peptide
  MOD_RES (1)..(1): N-terminal acetylation
  MOD_RES (21)..(21): C-terminal amidation
GYASFPWFVQLHQHKRSWEMA

SEQ ID NO: 2464 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHQRSWEMA

SEQ ID NO: 2465 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKQSWEMA

SEQ ID NO: 2466 - protein, 21 aa, Artificial Sequence
  Synthetic peptide
  MOD_RES (1)..(1): N-terminal acetylation
  MOD_RES (21)..(21): C-terminal amidation
GYASFSWFVQLHVHKRSWEMA

SEQ ID NO: 2467 - protein, 21 aa, Artificial Sequence
  Synthetic peptide
  MOD_RES (1)..(1): N-terminal acetylation
  MOD_RES (21)..(21): C-terminal amidation
GYASFPWFVQLSVHKRSWEMA

SEQ ID NO: 2468 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHSRSWEMA

SEQ ID NO: 2469 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKSSWEMA

SEQ ID NO: 2470 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSSEMA

SEQ ID NO: 2471 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWSMA

SEQ ID NO: 2472 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWESA

SEQ ID NO: 2473 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMS

SEQ ID NO: 2474 - protein, 21 aa, Artificial Sequence
  Synthetic peptide
  MOD_RES (1)..(1): N-terminal acetylation
  MOD_RES (21)..(21): C-terminal amidation
GYASFTWFVQLHVHKRSWEMA

SEQ ID NO: 2475 - protein, 21 aa, Artificial Sequence
  Synthetic peptide
  MOD_RES (1)..(1): N-terminal acetylation
  MOD_RES (21)..(21): C-terminal amidation
GYASFPWFVQLTVHKRSWEMA

SEQ ID NO: 2476 - protein, 21 aa, Artificial Sequence
  Synthetic peptide
  MOD_RES (1)..(1): N-terminal acetylation
  MOD_RES (21)..(21): C-terminal amidation
GYASFPWFVQLHTHKRSWEMA

SEQ ID NO: 2477 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHTRSWEMA

SEQ ID NO: 2478 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKTSWEMA

SEQ ID NO: 2479 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSTEMA

SEQ ID NO: 2480 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWTMA

SEQ ID NO: 2481 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWETA

SEQ ID NO: 2482 - protein, 21 aa, Artificial Sequence
  Synthetic peptide
  MOD_RES (1)..(1): N-terminal acetylation
  MOD_RES (21)..(21): C-terminal amidation
VYASFPWFVQLHVHKRSWEMA

SEQ ID NO: 2483 - protein, 21 aa, Artificial Sequence
  Synthetic peptide
  MOD_RES (1)..(1): N-terminal acetylation
  MOD_RES (21)..(21): C-terminal amidation
GVASFPWFVQLHVHKRSWEMA

SEQ ID NO: 2484 - protein, 21 aa, Artificial Sequence
  Synthetic peptide
  MOD_RES (1)..(1): N-terminal acetylation
  MOD_RES (21)..(21): C-terminal amidation
GYVSFPWFVQLHVHKRSWEMA

SEQ ID NO: 2485 - protein, 21 aa, Artificial Sequence
  Synthetic peptide
  MOD_RES (1)..(1): N-terminal acetylation
  MOD_RES (21)..(21): C-terminal amidation
GYASFVWFVQLHVHKRSWEMA

SEQ ID NO: 2486 - protein, 21 aa, Artificial Sequence
  Synthetic peptide
  MOD_RES (20)..(20): C-terminal amidation
  MOD_RES (21)..(21): N-terminal acetylation
GYASFPVFVQLHVHKRSWEMA

SEQ ID NO: 2487 - protein, 21 aa, Artificial Sequence
  Synthetic peptide
  MOD_RES (1)..(1): N-terminal acetylation
  MOD_RES (21)..(21): C-terminal amidation
GYASFPWFVQLVVHKRSWEMA

SEQ ID NO: 2488 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHVRSWEMA

SEQ ID NO: 2489 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKVSWEMA

SEQ ID NO: 2490 - protein, 21 aa, Artificial Sequence
  Synthetic peptide
  MOD_RES (1)..(1): N-terminal acetylation
  MOD_RES (21)..(21): C-terminal amidation
GYASFWWFVQLHVHKRSWEMA

SEQ ID NO: 2491 - protein, 21 aa, Artificial Sequence
  Synthetic peptide
  MOD_RES (1)..(1): N-terminal acetylation
  MOD_RES (21)..(21): C-terminal amidation
GYASFPWFVQLWVHKRSWEMA

SEQ ID NO: 2492 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHWRSWEMA

SEQ ID NO: 2493 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKWSWEMA

SEQ ID NO: 2494 - protein, 21 aa, Artificial Sequence
  Synthetic peptide
  MOD_RES (1)..(1): N-terminal acetylation
  MOD_RES (21)..(21): C-terminal amidation
GYASFYWFVQLHVHKRSWEMA

SEQ ID NO: 2495 - protein, 21 aa, Artificial Sequence
  Synthetic peptide
  MOD_RES (1)..(1): N-terminal acetylation
  MOD_RES (21)..(21): C-terminal amidation
GYASFPWFVQLYVHKRSWEMA

SEQ ID NO: 2496 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHYRSWEMA

SEQ ID NO: 2497 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKYSWEMA

SEQ ID NO: 2498 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGYASFPLAVQLHVSKRSKEMALARLYYKTS

SEQ ID NO: 2499-3000 - skipped (502 entries)

SEQ ID NO: 3001 - protein, 30 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  DISULFID (6)..(28): Cys residues linked via disfide bond
  MOD_RES (30)..(30): C-terminal amidation
XSGRGCTKVIVFTFRHNKLIGYERRYNCTS

SEQ ID NO: 3002 - protein, 30 aa, Artificial Sequence; identical to SEQ ID NO: 3001
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (30)..(30): C-terminal amidation

SEQ ID NO: 3003 - protein, 31 aa, Artificial Sequence
  Synthetic peptide
  MOD_RES (1)..(1): N-terminal acetylation
  MOD_RES (20)..(20): C-terminal amidation
  MOD_RES (30)..(30): Xaa is (13-Amino-4,7,10-trioxa-tridecayl)-succinamic acid
  MOD_RES (31)..(31): Linked to Biotin
SGRGCTKVIVFTFRHNKLIGYERRYNCTSXK

SEQ ID NO: 3004 - protein, 34 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (34)..(34): C-terminal amidation
XKKSGVWQTHPRYFWTMWPDIKGEVIVLFGTSKK

SEQ ID NO: 3005 - protein, 35 aa, Artificial Sequence
  Synthetic peptide
  MOD_RES (1)..(1): N-terminal acetylation
  MOD_RES (32)..(32): Xaa is (13-Amino-4,7,10-trioxa-tridecayl)-succinamic acid
  MOD_RES (35)..(35): Linked to Biotin
  MOD_RES (35)..(35): C-terminal amidation
KKSGVWQTHPRYFWTMWPDIKGEVIVLFGTSXKKK

SEQ ID NO: 3006 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGNTFVDERLLYFLTIGNMGMYAAQLKFRTS

SEQ ID NO: 3007 - protein, 13 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (13)..(13): C-terminal amidation
XLSLVGSFAVLCA

SEQ ID NO: 3008 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XGRGCTKVIVFTFRHNKLIGY

SEQ ID NO: 3009 - protein, 21 aa, Artificial Sequence
  Synthetic peptide
  MOD_RES (1)..(1): N-terminal Biotin
  MOD_RES (1)..(1): Xaa is (13-Amino-4,7,10-trioxa-tridecayl)-succinamic acid
  MOD_RES (21)..(21): C-terminal amidation
XCTKVIVFTFRHNKLIGYERR

SEQ ID NO: 3010 - protein, 21 aa, Artificial Sequence
  Synthetic peptide
  MOD_RES (1)..(1): N-terminal Biotin
  MOD_RES (1)..(1): Xaa is (13-Amino-4,7,10-trioxa-tridecayl)-succinamic acid
  MOD_RES (21)..(21): C-terminal amidation
XGCTKVIVFTFRHNKLIGYER

SEQ ID NO: 3011 - protein, 21 aa, Artificial Sequence
  Synthetic peptide
  MOD_RES (1)..(1): N-terminal Biotin
  MOD_RES (1)..(1): Xaa is (13-Amino-4,7,10-trioxa-tridecayl)-succinamic acid
  MOD_RES (21)..(21): C-terminal amidation
XVIVFTFRHNKLIGYERRYNC

SEQ ID NO: 3012 - protein, 19 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (19)..(19): C-terminal amidation
XYFLTIGNMGMYAAQLKFR

SEQ ID NO: 3013 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XYFLTIGNMGMYAAQLKFRTS

SEQ ID NO: 3014 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XLYFLTIGNMGMYAAQLKFRT

SEQ ID NO: 3015 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGQFWHGLLLPKGIVLNWTLKPWWMIGAFTS

SEQ ID NO: 3016 - protein, 33 aa, Artificial Sequence
  Synthetic peptide
  MOD_RES (1)..(1): N-terminal Biotinyl
  MOD_RES (32)..(32): Xaa is (13-Amino-4,7,10-trioxa-tridecayl)-succinamic acid
  MOD_RES (33)..(33): Linked to Biotin
  MOD_RES (33)..(33): C-terminal amidation
SGQFWHGLLLPKGIVLNWTLKPWWMIGAFTSXK

SEQ ID NO: 3017 - protein, 32 aa, Artificial Sequence
  Synthetic peptide
  MOD_RES (1)..(1): N-terminal acetylation
  MOD_RES (1)..(1): Xaa is (13-Amino-4,7,10-trioxa-tridecayl)-succinamic acid
  MOD_RES (32)..(32): C-terminal amidation
XSGRVSYYWGVKWSQQMPMSWWPDTWYTFDTS

SEQ ID NO: 3018 - protein, 33 aa, Artificial Sequence
  Synthetic peptide
  MOD_RES (1)..(1): N-terminal acetylation
  MOD_RES (32)..(32): Xaa is (13-Amino-4,7,10-trioxa-tridecayl)-succinamic acid
  MOD_RES (33)..(33): Linked to Biotin
  MOD_RES (33)..(33): C-terminal amidation
SGNTFVDERLLYFLTIGNMGMYAAQLKFRTSXK

SEQ ID NO: 3019 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGRFTTRLWYFSWDRLPWYMPFKQYVLSSTS

SEQ ID NO: 3020 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGSYQWWARPYRMWFGLPYWNQRVIFPWNTS

SEQ ID NO: 3021 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XLLYFLTIGNMGMYAAQLKFR

SEQ ID NO: 3022 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XTKVIVFTFRHNKLIGYERRY

SEQ ID NO: 3023 - protein, 17 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (17)..(17): C-terminal amidation
XVIVFTFRHNKLIGYER

SEQ ID NO: 3024 - protein, 20 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (20)..(20): C-terminal amidation
FQRKGNVFVDGYFERLRAKL

SEQ ID NO: 3025 - protein, 31 aa, Artificial Sequence
  Synthetic peptide
  MOD_RES (1)..(1): N-terminal acetylation
  MOD_RES (31)..(31): C-terminal amidation
SGNTFVDERLLYFLTIGNMGMYAAQLKFRTS

SEQ ID NO: 3026 - protein, 23 aa, Artificial Sequence
  Synthetic peptide
  MOD_RES (1)..(1): N-terminal acetylation
  MOD_RES (23)..(23): C-terminal amidation
CTKVIVFTFRHNKLIGYERRYNC

SEQ ID NO: 3027 - protein, 30 aa, Artificial Sequence
  Synthetic peptide
  MOD_RES (1)..(1): N-terminal acetylation
  MOD_RES (30)..(30): C-terminal amidation
KKSGRGCTKVIVFTFRHNKLIGYERRYNKK

SEQ ID NO: 3028 - protein, 32 aa, Artificial Sequence
  Synthetic peptide
  MOD_RES (1)..(1): N-terminal acetylation
  MOD_RES (32)..(32): C-terminal amidation
KKSGVWQTHPRYFWTMWPDIKGEVIVLFGTKK

SEQ ID NO: 3029 - protein, 33 aa, Artificial Sequence
  Synthetic peptide
  MOD_RES (1)..(1): N-terminal acetylation
  MOD_RES (33)..(33): C-terminal amidation
KKSGRGCTKVIVFTFRHNKLIGYERRYNCTSKK

SEQ ID NO: 3030 - protein, 24 aa, Artificial Sequence
  Synthetic peptide
  MOD_RES (1)..(1): N-terminal acetylation
  MOD_RES (24)..(24): C-terminal amidation
KKVIVFTFRHNKLIGYERRYNCKK

SEQ ID NO: 3031 - protein, 35 aa, Artificial Sequence
  Synthetic peptide
  MOD_RES (1)..(1): N-terminal acetylation
  MOD_RES (35)..(35): C-terminal amidation
KKSGNTFVDERLLYFLTIGNMGMYAAQLKFRTSKK

SEQ ID NO: 3032 - protein, 30 aa, Artificial Sequence
  Synthetic peptide
  MOD_RES (1)..(1): N-terminal acetylation
  MOD_RES (30)..(30): C-terminal amidation
KKGCTKVIVFTFRHNKLIGYERRYNCTSKK

SEQ ID NO: 3033 - protein, 27 aa, Artificial Sequence
  Synthetic peptide
  MOD_RES (1)..(1): N-terminal acetylation
  MOD_RES (27)..(27): C-terminal amidation
KKKVIVFTFRHNKLIGYERRYNCTSKK

SEQ ID NO: 3034 - protein, 23 aa, Artificial Sequence
  Synthetic peptide
  MOD_RES (1)..(1): N-terminal acetylation
  MOD_RES (23)..(23): C-terminal amidation
VDERLLYFLTIGNMGMYAAQLKF

SEQ ID NO: 3035 - protein, 30 aa, Artificial Sequence
  Synthetic peptide
  MOD_RES (1)..(1): N-terminal acetylation
  MOD_RES (30)..(30): C-terminal amidation
KKGVWQTHPRYFWTMWPDIKGEVIVLFGKK

SEQ ID NO: 3036 - protein, 33 aa, Artificial Sequence
  Synthetic peptide
  MOD_RES (1)..(1): N-terminal acetylation
  MOD_RES (33)..(33): C-terminal amidation
KKSGVWQTHPRYFWTMWPDIKGEVIVLFGTSKK

SEQ ID NO: 3037 - protein, 32 aa, Artificial Sequence
  Synthetic peptide
  MOD_RES (1)..(1): N-terminal acetylation
  MOD_RES (32)..(32): C-terminal amidation
KKGVWQTHPRYFWTMWPDIKGEVIVLFGTSKK

SEQ ID NO: 3038 - protein, 25 aa, Artificial Sequence
  Synthetic peptide
  MOD_RES (1)..(1): N-terminal Carboxyfluorescein
  MOD_RES (25)..(25): C-terminal amidation
TFVDERLLYFLTIGNMGMYAAQLKF

SEQ ID NO: 3039 - protein, 24 aa, Artificial Sequence
  Synthetic peptide
  MOD_RES (1)..(1): N-terminal acetylation
  MOD_RES (24)..(24): C-terminal amidation
FVDERLLYFLTIGNMGMYAAQLKF

SEQ ID NO: 3040 - protein, 24 aa, Artificial Sequence
  Synthetic peptide
  MOD_RES (1)..(1): N-terminal acetylation
  MOD_RES (24)..(24): C-terminal amidation
TFVDERLLYFLTIGNMGMYAAQLK

SEQ ID NO: 3041 - protein, 26 aa, Artificial Sequence
  Synthetic peptide
  MOD_RES (1)..(1): N-terminal acetylation
  MOD_RES (26)..(26): C-terminal amidation
GCTKVIVFTFRHNKLIGYERRYNCTS

SEQ ID NO: 3042 - protein, 25 aa, Artificial Sequence
  Synthetic peptide
  MOD_RES (1)..(1): N-terminal acetylation
  MOD_RES (25)..(25): C-terminal amidation
CTKVIVFTFRHNKLIGYERRYNCTS

SEQ ID NO: 3043 - protein, 24 aa, Artificial Sequence
  Synthetic peptide
  MOD_RES (1)..(1): N-terminal acetylation
  MOD_RES (24)..(24): C-terminal amidation
TKVIVFTFRHNKLIGYERRYNCTS

SEQ ID NO: 3044 - protein, 25 aa, Artificial Sequence
  Synthetic peptide
  MOD_RES (1)..(1): N-terminal acetylation
  MOD_RES (25)..(25): C-terminal amidation
GCTKVIVFTFRHNKLIGYERRYNCT

SEQ ID NO: 3045 - protein, 24 aa, Artificial Sequence
  Synthetic peptide
  MOD_RES (1)..(1): N-terminal acetylation
  MOD_RES (24)..(24): C-terminal amidation
GCTKVIVFTFRHNKLIGYERRYNC

SEQ ID NO: 3046 - protein, 29 aa, Artificial Sequence
  Synthetic peptide
  MOD_RES (1)..(1): N-terminal acetylation
  MOD_RES (29)..(29): C-terminal amidation
KKGVWQTHPRYFWTMWPDIKGEVIVLFKK

SEQ ID NO: 3047 - protein, 29 aa, Artificial Sequence
  Synthetic peptide
  MOD_RES (1)..(1): N-terminal acetylation
  MOD_RES (29)..(29): C-terminal amidation
SGRGCTKVIVFTFRHNKLIGYERRYNCTS

SEQ ID NO: 3048 - protein, 23 aa, Artificial Sequence
  Synthetic peptide
  MOD_RES (1)..(1): N-terminal aceylation
  MOD_RES (23)..(23): C-terminal amidation
KKSGNTFVDERLLYFLTIGNMKK

SEQ ID NO: 3049 - protein, 29 aa, Artificial Sequence
  Synthetic peptide
  MOD_RES (1)..(1): N-terminal acetylation
  MOD_RES (29)..(29): C-terminal amidation
TNYTGSEKCIRFVTRRYLGVRINCFHKGS

SEQ ID NO: 3050 - protein, 29 aa, Artificial Sequence
  Synthetic peptide
  MOD_RES (1)..(1): N-terminal acetylation
  MOD_RES (29)..(29): C-terminal amidation
TRNVVRRYECFGSTGCIKYFIHSRTGLNK

SEQ ID NO: 3051 - protein, 27 aa, Artificial Sequence
  Synthetic peptide
  MOD_RES (1)..(1): N-terminal acetylation
  MOD_RES (27)..(27): C-terminal amidation
KKSGRGCTKVIVFTFRHNKLIGYERKK

SEQ ID NO: 3052 - protein, 24 aa, Artificial Sequence
  Synthetic peptide
  MOD_RES (1)..(1): N-terminal acetylation
  MOD_RES (24)..(24): C-terminal N-ethyl
KKGRGCTKVIVFTFRHNKLIGYKK

SEQ ID NO: 3053 - protein, 24 aa, Artificial Sequence
  Synthetic peptide
  MOD_RES (1)..(1): N-terminal acetylation
  MOD_RES (24)..(24): C-terminal amidation
KKCTKVIVFTFRHNKLIGYERRKK

SEQ ID NO: 3054 - protein, 30 aa, Artificial Sequence
  Synthetic peptide
  MOD_RES (1)..(1): N-terminal acetylation
  MOD_RES (30)..(30): C-terminal amidation
MLGVLMRGISALTGDYTARFEFYLNKQTFN

SEQ ID NO: 3055 - protein, 24 aa, Artificial Sequence
  Synthetic peptide
  MOD_RES (1)..(1): N-terminal acetylation
  MOD_RES (24)..(24): C-terminal amidation
KKGCTKVIVFTFRHNKLIGYERKK

SEQ ID NO: 3056 - protein, 33 aa, Artificial Sequence
  Synthetic peptide
  MOD_RES (1)..(1): N-terminal acetylation
  MOD_RES (33)..(33): C-terminal amidation
KKVGSVTRWSMYGPIFIKFTWTLEQPVGWDHKK

SEQ ID NO: 3057 - protein, 23 aa, Artificial Sequence
  Synthetic peptide
  MOD_RES (1)..(1): N-terminal acetylation
  MOD_RES (23)..(23): C-terminal amidation
KKFWTMWPDIKGEVIVLFGTSKK

SEQ ID NO: 3058 - protein, 24 aa, Artificial Sequence
  Synthetic peptide
  MOD_RES (1)..(1): N-terminal acetylation
  MOD_RES (24)..(24): C-terminal amidation
KKHPRYFWTMWPDIKGEVIVLFKK

SEQ ID NO: 3059 - protein, 24 aa, Artificial Sequence
  Synthetic peptide
  MOD_RES (1)..(1): N-terminal acetylation
  MOD_RES (24)..(24): C-terminal amidation
KKYFWTMWPDIKGEVIVLFGTSKK

SEQ ID NO: 3060 - protein, 24 aa, Artificial Sequence
  Synthetic peptide
  MOD_RES (1)..(1): N-terminal acetylation
  MOD_RES (24)..(24): C-terminal amidation
KKSGNTFVDERLLYFLTIGNMGKK

SEQ ID NO: 3061 - protein, 24 aa, Artificial Sequence
  Synthetic peptide
  MOD_RES (1)..(1): N-terminal acetylation
  MOD_RES (24)..(24): C-terminal amidation
KKSGRGCTKVIVFTFRHNKLIGKK

SEQ ID NO: 3062 - protein, 24 aa, Artificial Sequence
  Synthetic peptide
  MOD_RES (1)..(1): N-terminal acetylation
  MOD_RES (24)..(24): C-terminal amidation
KKTKVIVFTFRHNKLIGYERRYKK

SEQ ID NO: 3063 - protein, 24 aa, Artificial Sequence
  Synthetic peptide
  MOD_RES (1)..(1): N-terminal acetylation
  MOD_RES (24)..(24): C-terminal amidation
KKKVIVFTFRHNKLIGYERRYNKK

SEQ ID NO: 3064 - protein, 24 aa, Artificial Sequence
  Synthetic peptide
  MOD_RES (1)..(1): N-terminal acetylation
  MOD_RES (24)..(24): C-terminal amidation
KKIVFTFRHNKLIGYERRYNCTKK

SEQ ID NO: 3065 - protein, 33 aa, Artificial Sequence
  Synthetic peptide
  MOD_RES (1)..(1): N-terminal acetylation
  MOD_RES (33)..(33): C-terminal amidation
KKLTGDWTYFWSKVIWGPGVIERQMPVSTFHKK

SEQ ID NO: 3066 - protein, 29 aa, Artificial Sequence
  Synthetic peptide
  MOD_RES (1)..(1): N-terminal acetylation
  MOD_RES (29)..(29): C-terminal amidation
KKSGVWQTHPRYFWTMWPDIKGEVIVLKK

SEQ ID NO: 3067 - protein, 26 aa, Artificial Sequence
  Synthetic peptide
  MOD_RES (1)..(1): N-terminal acetylation
  MOD_RES (26)..(26): C-terminal amidation
KKSGVWQTHPRYFWTMWPDIKGEVKK

SEQ ID NO: 3068 - protein, 23 aa, Artificial Sequence
  Synthetic peptide
  MOD_RES (1)..(1): N-terminal acetylation
  MOD_RES (23)..(23): C-terminal amidation
KKSGVWQTHPRYFWTMWPDIKKK

SEQ ID NO: 3069 - protein, 29 aa, Artificial Sequence
  Synthetic peptide
  MOD_RES (1)..(1): N-terminal acetylation
  MOD_RES (29)..(29): C-terminal amidation
KKQTHPRYFWTMWPDIKGEVIVLFGTSKK

SEQ ID NO: 3070 - protein, 26 aa, Artificial Sequence
  Synthetic peptide
  MOD_RES (1)..(1): N-terminal acetylation
  MOD_RES (26)..(26): C-terminal amidation
KKPRYFWTMWPDIKGEVIVLFGTSKK

SEQ ID NO: 3071 - protein, 24 aa, Artificial Sequence
  Synthetic peptide
  MOD_RES (1)..(1): N-terminal acetylation
  MOD_RES (24)..(24): C-terminal amidation
KKSGVWQTHPRYFWTMWPDIKGKK

SEQ ID NO: 3072 - protein, 24 aa, Artificial Sequence
  Synthetic peptide
  MOD_RES (1)..(1): N-terminal acetylation
  MOD_RES (24)..(24): C-terminal amidation
KKWQTHPRYFWTMWPDIKGEVIKK

SEQ ID NO: 3073 - protein, 32 aa, Artificial Sequence
  Synthetic peptide
  MOD_RES (1)..(1): N-terminal acetylation
  MOD_RES (32)..(32): C-terminal amidation
KKSGNTFVDERLLYFLTIGNMGMYAAQLKFKK

SEQ ID NO: 3074 - protein, 29 aa, Artificial Sequence
  Synthetic peptide
  MOD_RES (1)..(1): N-terminal acetylation
  MOD_RES (29)..(29): C-terminal amidation
KKSGNTFVDERLLYFLTIGNMGMYAAQKK

SEQ ID NO: 3075 - protein, 26 aa, Artificial Sequence
  Synthetic peptide
  MOD_RES (1)..(1): N-terminal acetylation
  MOD_RES (26)..(26): C-terminal amidation
KKSGNTFVDERLLYFLTIGNMGMYKK

SEQ ID NO: 3076 - protein, 32 aa, Artificial Sequence
  Synthetic peptide
  MOD_RES (1)..(1): N-terminal acetylation
  MOD_RES (32)..(32): C-terminal amidation
KKTFVDERLLYFLTIGNMGMYAAQLKFRTSKK

SEQ ID NO: 3077 - protein, 29 aa, Artificial Sequence
  Synthetic peptide
  MOD_RES (1)..(1): N-terminal acetylation
  MOD_RES (29)..(29): C-terminal amidation
KKDERLLYFLTIGNMGMYAAQLKFRTSKK

SEQ ID NO: 3078 - protein, 26 aa, Artificial Sequence
  Synthetic peptide
  MOD_RES (1)..(1): N-terminal acetylation
  MOD_RES (26)..(26): C-terminal amidation
KKLLYFLTIGNMGMYAAQLKFRTSKK

SEQ ID NO: 3079 - protein, 23 aa, Artificial Sequence
  Synthetic peptide
  MOD_RES (1)..(1): N-terminal acetylation
  MOD_RES (23)..(23): C-terminal amidation
KKFLTIGNMGMYAAQLKFRTSKK

SEQ ID NO: 3080 - protein, 24 aa, Artificial Sequence
  Synthetic peptide
  MOD_RES (1)..(1): N-terminal acetylation
  MOD_RES (24)..(24): C-terminal amidation
KKLLYFLTIGNMGMYAAQLKFRKK

SEQ ID NO: 3081 - protein, 24 aa, Artificial Sequence
  Synthetic peptide
  MOD_RES (1)..(1): N-terminal acetylation
  MOD_RES (24)..(24): C-terminal amidation
KKLYFLTIGNMGMYAAQLKFRTKK

SEQ ID NO: 3082 - protein, 24 aa, Artificial Sequence
  Synthetic peptide
  MOD_RES (1)..(1): N-terminal acetylation
  MOD_RES (24)..(24): C-terminal amidation
KKYFLTIGNMGMYAAQLKFRTSKK

SEQ ID NO: 3083 - protein, 24 aa, Artificial Sequence
  Synthetic peptide
  MOD_RES (1)..(1): N-terminal acetylation
  MOD_RES (24)..(24): C-terminal amidation
KKVFTFRHNKLIGYERRYNCTSKK

SEQ ID NO: 3084 - protein, 22 aa, Artificial Sequence
  Synthetic peptide
  MOD_RES (1)..(1): N-terminal acetylation
  MOD_RES (22)..(22): C-terminal amidation
TFVDERLLYFLTIGNMGMYAAQ

SEQ ID NO: 3085 - protein, 31 aa, Artificial Sequence
  Synthetic peptide
  MOD_RES (1)..(1): N-terminal acetylation
  MOD_RES (31)..(31): C-terminal amidation
SGDTFVDERLLYFLTIGNMRMYAVQLKFRTS

SEQ ID NO: 3086 - protein, 31 aa, Artificial Sequence
  Synthetic peptide
  MOD_RES (1)..(1): N-terminal acetylation
  MOD_RES (31)..(31): C-terminal amidation
SGDTFVDERLLYFLTTGNMRMYAVQLKFRTS

SEQ ID NO: 3087 - protein, 31 aa, Artificial Sequence
  Synthetic peptide
  MOD_RES (1)..(1): N-terminal acetylation
  MOD_RES (31)..(31): C-terminal amidation
SGDTFVDERLLYFLTIGDMRMYAVQLKFRTS

SEQ ID NO: 3088 - protein, 31 aa, Artificial Sequence
  Synthetic peptide
  MOD_RES (1)..(1): N-terminal acetylation
  MOD_RES (31)..(31): C-terminal amidation
KKGVWQTHPRYFWTMWPDIKGEVIVLFGTKK

SEQ ID NO: 3089 - protein, 30 aa, Artificial Sequence
  Synthetic peptide
  MOD_RES (1)..(1): N-terminal acetylation
  MOD_RES (30)..(30): C-terminal amidation
KKVWQTHPRYFWTMWPDIKGEVIVLFGTKK

SEQ ID NO: 3090 - protein, 29 aa, Artificial Sequence
  Synthetic peptide
  MOD_RES (1)..(1): N-terminal acetylation
  MOD_RES (29)..(29): C-terminal amidation
KKWQTHPRYFWTMWPDIKGEVIVLFGTKK

SEQ ID NO: 3091 - protein, 31 aa, Artificial Sequence
  Synthetic peptide
  MOD_RES (1)..(1): N-terminal acetylation
  MOD_RES (31)..(31): C-terminal amidation
SGGRKHKHFLRSNGKPSRALCSMHFWRWSTS

SEQ ID NO: 3092 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGGRKHLHFLRSNGKPSRALCSMHFWRWSTS

SEQ ID NO: 3093 - protein, 31 aa, Artificial Sequence; identical to SEQ ID NO: 1293
  Synthetic peptide
  MOD_RES (1)..(1): N-terminal acetylation
  MOD_RES (31)..(31): C-terminal amidation

SEQ ID NO: 3094 - protein, 31 aa, Artificial Sequence
  Synthetic peptide
  MOD_RES (1)..(1): N-terminal acetylation
  MOD_RES (31)..(31): C-terminal amidation
KGSSRSGHNALKTHSWMSPFRRRGSWSLHFK

SEQ ID NO: 3095 - protein, 31 aa, Artificial Sequence
  Synthetic peptide
  MOD_RES (1)..(1): N-terminal acetylation
  MOD_RES (31)..(31): C-terminal amidation
KSRSGFWHAWSHRTRPMKSRLHLGKFSNSSG

SEQ ID NO: 3096 - protein, 28 aa, Artificial Sequence
  Synthetic peptide
  MOD_RES (1)..(1): N-terminal acetylation
  MOD_RES (28)..(28): C-terminal amidation
SGGRKHKHFLRSNGKPSRALSSMHFWRW

SEQ ID NO: 3097 - protein, 25 aa, Artificial Sequence
  Synthetic peptide
  MOD_RES (1)..(1): N-terminal acetylation
  MOD_RES (25)..(25): N-terminal amidation
SGGRKHKHFLRSNGKPSRALSSMHF

SEQ ID NO: 3098 - protein, 22 aa, Artificial Sequence
  Synthetic peptide
  MOD_RES (1)..(1): N-terminal acetylation
  MOD_RES (22)..(22): C-terminal amidation
SGGRKHKHFLRSNGKPSRALSS

SEQ ID NO: 3099 - protein, 19 aa, Artificial Sequence
  Synthetic peptide
  MOD_RES (1)..(1): N-terminal acetylation
  MOD_RES (19)..(19): C-terminal amidation
SGGRKHKHFLRSNGKPSRA

SEQ ID NO: 3100 - protein, 28 aa, Artificial Sequence
  Synthetic peptide
  MOD_RES (1)..(1): N-terminal acetylation
  MOD_RES (28)..(28): C-terminal amidation
RKHKHFLRSNGKPSRALSSMHFWRWSTS

SEQ ID NO: 3101 - protein, 25 aa, Artificial Sequence
  Synthetic peptide
  MOD_RES (1)..(1): N-terminal acetylation
  MOD_RES (25)..(25): C-terminal amidation
KHFLRSNGKPSRALSSMHFWRWSTS

SEQ ID NO: 3102 - protein, 22 aa, Artificial Sequence
  Synthetic peptide
  MOD_RES (1)..(1): N-terminal acetylation
  MOD_RES (22)..(22): C-terminal amidation
LRSNGKPSRALSSMHFWRWSTS

SEQ ID NO: 3103 - protein, 19 aa, Artificial Sequence
  Synthetic peptide
  MOD_RES (1)..(1): N-terminal acetylation
  MOD_RES (19)..(19): C-terminal amidation
NGKPSRALSSMHFWRWSTS

SEQ ID NO: 3104 - protein, 20 aa, Artificial Sequence
  Synthetic peptide
  MOD_RES (1)..(1): N-terminal acetylation
  MOD_RES (20)..(20): C-terminal amidation
SGGRKHKHFLRSNGKPSRAL

SEQ ID NO: 3105 - protein, 20 aa, Artificial Sequence
  Synthetic peptide
  MOD_RES (1)..(1): N-terminal acetylation
  MOD_RES (20)..(20): C-terminal amidation
RKHKHFLRSNGKPSRALSSM

SEQ ID NO: 3106 - protein, 20 aa, Artificial Sequence
  Synthetic peptide
  MOD_RES (1)..(1): N-terminal acetylation
  MOD_RES (20)..(20): C-terminal amidation
KHFLRSNGKPSRALSSMHFW

SEQ ID NO: 3107 - protein, 20 aa, Artificial Sequence
  Synthetic peptide
  MOD_RES (1)..(1): N-terminal acetylation
  MOD_RES (20)..(20): C-terminal amidation
LRSNGKPSRALSSMHFWRWS

SEQ ID NO: 3108 - protein, 20 aa, Artificial Sequence
  Synthetic peptide
SNGKPSRALSSMHFWRWSTS

SEQ ID NO: 3109 - protein, 15 aa, Artificial Sequence
  Synthetic peptide
  MOD_RES (1)..(1): Xaa is selected from the group consisting of Leu, Pro, Lys, Ser, Trp, Val, Asn, and Gln
  MOD_RES (2)..(2): Xaa is selected from the group consisting of Leu, Arg, Asn, Phe, and Ile
  MOD_RES (3)..(3): Xaa is selected from the group consisting of Tyr, Val, Pro, and Cys
  MOD_RES (4)..(4): Xaa is selected from the group consisting of Phe, Leu, Gly
  MOD_RES (5)..(5): Xaa is selected from the group consisting of Leu, Trp, Val, Ala, Met, Thr, and Ser
  MOD_RES (6)..(6): Xaa is selected from the group consisting of Thr, Phe, Val, Arg, Ala, Asp, Leu, Glu, Ser, and Tyr
  MOD_RES (7)..(7): Xaa is selected from the group consisting of Ile, Met, Gly, Gln, Asp, and Arg
  MOD_RES (8)..(8): Xaa is selected from the group consisting of Gly, Trp, Tyr, Leu, Met, and His
  MOD_RES (9)..(9): Xaa is selected from the group consisting of Asn, Pro, Phe, His, Lys, and Tyr
  MOD_RES (10)..(10): Xaa is selected from the group consisting of Met, Asp, Glu, Val, Gly, and Lys
  MOD_RES (11)..(11): Xaa is selected from the group consisting of Gly, Ile, Arg, Ser, Thr, and Leu
  MOD_RES (12)..(12): Xaa is selected from the group consisting of Met, Lys, Leu, and Ile
  MOD_RES (13)..(13): Xaa is selected from the group consisting of Tyr, Gly, Arg, and Ser
  MOD_RES (14)..(14): Xaa is selected from the group consisting of Ala, Glu, Ser, Cys, and Tyr
  MOD_RES (15)..(15): Xaa is selected from the group consisting of Ala, Val, Lys, and Glu
XXXXXXXXXXXXXXX

SEQ ID NO: 3110 - protein, 4 aa, Artificial Sequence
  Synthetic peptide
  MOD_RES (1)..(1): Xaa is selected from a group consisting of Val, Trp, Tyr, and Phe
  MOD_RES (2)..(2): Xaa is selected from a group consisting of Asp, Gln, and Ser
  MOD_RES (3)..(3): Xaa is selected from a group consisting of Glu, Thr, Asn, and Ser
  MOD_RES (4)..(4): Xaa is selected from a group consisting of Arg, His, Lys, and Ala
XXXX

SEQ ID NO: 3111 - protein, 5 aa, Artificial Sequence
  Synthetic peptide
  MOD_RES (1)..(1): Xaa is selected from a group consisting of Phe and Val
  MOD_RES (2)..(2): Xaa is selected from a group consisting of Val, Trp, Tyr, and Phe
  MOD_RES (3)..(3): Xaa is selected from a group consisting of Asp, Gln, and Ser
  MOD_RES (4)..(4): Xaa is selected from a group consisting of Glu, Thr, Asn, and Ser
  MOD_RES (5)..(5): Xaa is selected from a group consisting of Arg, His, Lys, and Ala
XXXXX

SEQ ID NO: 3112 - protein, 6 aa, Artificial Sequence
  Synthetic peptide
  MOD_RES (1)..(1): Xaa is selected from a group consisting of Thr and Gly
  MOD_RES (2)..(2): Xaa is selected from a group consisting of Phe and Val
  MOD_RES (3)..(3): Xaa is selected from a group consisting of Val, Trp, Tyr, and Phe
  MOD_RES (4)..(4): Xaa is selected from a group consisting of Asp, Gln, and Ser
  MOD_RES (5)..(5): Xaa is selected from a group consisting of Glu, Thr, Asn, and Ser
  MOD_RES (6)..(6): Xaa is selected from a group consisting of Arg, His, Lys, and Ala
XXXXXX

SEQ ID NO: 3113 - protein, 4 aa, Artificial Sequence
  Synthetic peptide
  MOD_RES (1)..(1): Xaa is selected from a group consisting of Gln, Ile, Glu, Trp, Arg, Leu, and Asn
  MOD_RES (2)..(2): Xaa is selected from a group consisting of Leu, Val, Met, and Arg
  MOD_RES (3)..(3): Xaa is selected from a group consisting of Lys, Leu, Ala, and Tyr
XXXF

SEQ ID NO: 3114 - protein, 5 aa, Artificial Sequence
  Synthetic peptide
  MOD_RES (1)..(1): Xaa is selected from a group consisting of Gln, Ile, Glu, Trp, Arg, Leu, and Asn
  MOD_RES (2)..(2): Xaa is selected from a group consisting of Leu, Val, Met, and Arg
  MOD_RES (3)..(3): Xaa is selected from a group consisting of Lys, Leu, Ala, and Tyr
XXXPG

SEQ ID NO: 3115 - protein, 6 aa, Artificial Sequence
  Synthetic peptide
  MOD_RES (1)..(1): Xaa is selected from a group consisting of Gln, Ile, Glu, Trp, Arg, Leu, and Asn
  MOD_RES (2)..(2): Xaa is selected from a group consisting of Leu, Val, Met, and Arg
  MOD_RES (3)..(3): Xaa is selected from a group consisting of Lys, Leu, Ala, and Tyr
XXXPGT

SEQ ID NO: 3116 - protein, 20 aa, Artificial Sequence
  Synthetic peptide
  MOD_RES (1)..(1): Xaa is an amino acid selected from the group consisting of Bhf, Cys, Asp, Phe, Gly, His, Ile, Lys, Leu, Met, Asn, Nmf, Gln, Arg, Thr, Val, Trp and Tyr
  MOD_RES (2)..(2): Xaa is an amino acid selected from the group consisting Gly, Lys, and Gln
  MOD_RES (3)..(3): Xaa is an amino acid selected from the group consisting Ala, Aib, Bhs, Cys, Asp, Glu, Phe, Gly, His, Ile, Lys, Leu, Met, Asn, Pro, Gln, Arg, Ser, Thr, Val, Trp and Tyr
  MOD_RES (4)..(4): Xaa is an amino acid selected from the group consisting Ala, Aib, Bhk, Cys, Asp, Glu, Phe, Gly, His, Ile, Lys, D-Lys, Leu, Met, Asn, Nmk, Pro, Gln, Arg, Ser, Thr, Val, Trp and Tyr
  MOD_RES (5)..(5): Xaa is an amino acid selected from the group consisting D-Ala, Ala, Aib, Bal, Cys, Asp, D-Asp, Glu, Phe, Gly, His, Lys, D-Lys, Leu, Met, Asn, Nmg, D-Pro, Gln, Arg, Ser, Thr, Val, Trp and Tyr
  MOD_RES (6)..(6): Xaa is an amino acid selected from the group consisting Ala, Aib, Btq, Cys, Asp, Glu, Phe, Gly, His, Ile, Lys, Leu, Met, Asn, Gln, Arg, Ser, Thr, Val, Trp and Tyr
  MOD_RES (7)..(7): Xaa is an amino acid selected from the group consisting Ala, Phe, Gly, Ile, Lys, Leu, Nmv, Pro, Gln, Ser, Val, Trp and Tyr
  MOD_RES (8)..(8): Xaa is an amino acid selected from the group consisting Phe, His, Lys, Trp and Tyr
  MOD_RES (9)..(9): Xaa is an amino acid selected from the group consisting Ala, Aib, D-Phe, Ile, Lys, Ser, Thr, and Val
  MOD_RES (10)..(10): Xaa is an amino acid selected from the group consisting Ala, Aib, Cys, Asp, Glu, Phe, Gly, His, Ile, Lys, Leu, Met, Asn, Nmf, Pro, Gln, Arg, Ser, Thr, Val, Trp and Tyr
  MOD_RES (11)..(11): Xaa is an amino acid selected from the group consisting Aib, Cys, Lys, Gly, and Nmg
  MOD_RES (13)..(13): Xaa is an amino acid selected from the group consisting Ala, Aib, Cys, Glu, Phe, Gly, His, Lys, Leu, Met, Gln, Arg, Trp, and Tyr
  MOD_RES (14)..(14): Xaa is an amino acid selected from the group consisting Ala, Aib, Bhe, Cys, Asp, Glu, Phe, Gly, His, Ile, Lys, Leu, Met, Asn, Pro, Gln, Arg, Ser, Thr, Val, Trp, and Tyr
  MOD_RES (15)..(15): Xaa is an amino acid selected from the group consisting (omega-methyl)-Arg, Asp, Glu, Lys and Arg
  MOD_RES (17)..(17): Xaa is an amino acid selected from the group consisting (omega-methyl)-Arg, Ala, Aib, Bhr, Cys, Cha, Cit, Asp, Dab, Dap, Glu, Eag, Eew, Phe, Gly, His, Har, Hci, Hle, Ile, Lys, Leu, Met, Asn, Nle, Nva, Opa, Orn, Gln, Arg, Ser, Thr, Val, Trp and Tyr
  MOD_RES (18)..(18): Xaa is an amino acid selected from the group consisting Ala, Bal, Cys, Asp, Glu, Phe, Gly, His, Ile, Lys, Leu, Met, Asn, Gln, Arg, Ser, Thr, Val, Trp and Tyr
  MOD_RES (19)..(19): Xaa is an amino acid selected from the group consisting Bhk, Lys, Arg, and Val
  MOD_RES (20)..(20): Xaa is an amino acid selected from the group consisting of Aib, Bhl, Cys, Phe, Gly, His, Ile, Lys, Leu, Nml, Gln, Arg, Ser, Thr, Val, Trp and Tyr or is absent
XXXXXXXXXXXYXXXLXXXX

SEQ ID NO: 3117 - protein, 20 aa, Artificial Sequence
  Synthetic peptide
  MOD_RES (1)..(1): Xaa is selected from any amino acid
  MOD_RES (3)..(3): Xaa is selected from any amino acid
  MOD_RES (4)..(4): Xaa is selected from any amino acid
  MOD_RES (5)..(5): Xaa is selected from any amino acid
  MOD_RES (6)..(6): Xaa is selected from any amino acid
  MOD_RES (7)..(7): Xaa is an amino acid selected from the group consisting of Ile and Val
  MOD_RES (8)..(8): Xaa is selected from any amino acid
  MOD_RES (10)..(10): Xaa is selected from any amino acid
  MOD_RES (13)..(13): Xaa is an amino acid selected from the group consisting of Cys and Phe
  MOD_RES (14)..(14): Xaa is selected from any amino acid
  MOD_RES (17)..(17): Xaa is selected from any amino acid
  MOD_RES (18)..(18): Xaa is selected from any amino acid
  MOD_RES (20)..(20): Xaa is an amino acid selected from the group consisting of Lys and Leu
XQXXXXXXVXGYXXRLXXKX

SEQ ID NO: 3118 - protein, 23 aa, Artificial Sequence
  Synthetic peptide
  MOD_RES (1)..(1): Xaa is an amino acid selected from a group consisting of Ala, Asp, Glu, Phe, Gly, His, Ile, Lys, Leu, Pro, Arg, Ser, Thr, Val and Trp or is absent
  MOD_RES (2)..(2): Xaa is an amino acid selected from a group consisting of Ala, Asp, Glu, Phe, Gly, His, Ile, Lys, Leu, Met, Pro, Arg, Ser, Thr, Val and Trp or is absent
  misc_feature (3)..(3): Xaa can be any naturally occurring amino acid
  MOD_RES (4)..(4): Xaa is an amino acid selected from a group consisting of Ala, Asp, Glu, Phe, Gly, Ile, Lys, Leu, Arg, Ser, Thr, Val and Trp
  MOD_RES (6)..(6): Xaa is an amino acid selected from a group consisting of Phe, His, Ile, Lys, Leu, Arg, Val and Trp
  MOD_RES (7)..(7): Xaa is an amino acid selected from a group consisting of Cys, Hcy, Dap and Lys, preferably selected from the group consisting of Cys and Hcy
  DISULFID (7)..(18): Cys residues linked via disulfide bond
  MOD_RES (8)..(8): Xaa is an amino acid selected from a group consisting of Ala, Gly, Arg, Ser and Thr
  MOD_RES (9)..(9): Xaa is an amino acid selected from a group consisting of Ala, Ile, Lys, Leu, Met, D-Met, Nle, D-Pro, Arg, and Val
  MOD_RES (10)..(10): Xaa is an amino acid selected from a group consisting of Ala, Gly, Ile, Lys, Leu, Pro, Arg, Ser, Thr and Val
  MOD_RES (11)..(11): Xaa is an amino acid selected from a group consisting of Asp, Glu, Gly, Ser and Thr
  MOD_RES (12)..(12): Xaa is an amino acid selected from a group consisting of Ala, D-Ala, Asp, D-Asp, Glu, D-Glu, Phe, D-Phe, Gly, Ile, Lys, D-Lys, Leu, D-Leul, Met, D-Met, Nle, D-Nle, Pro, D-Pro, Arg, D-Arg, Ser, D-Ser, Thr, D-Thr, Val, D-Val, Trp and D-Trp
  MOD_RES (13)..(13): Xaa is an amino acid selected from a group consisting of Ala, Asp, D-Asp, Glu, D-Glu, Phe, Gly, Ile, Lys, Leu, Arg, Ser, D-Ser, Thr, Val and Trp
  MOD_RES (15)..(15): Xaa is an amino acid selected from a group consisting of Ala, Asp, Glu, Phe, Gly, Ile, Lys, Leu, Met,  Nle,  Arg, Ser, Thr, Val and Trp
  MOD_RES (16)..(16): Xaa is an amino acid selected from a group consisting of Ala, Asp, Glu, Phe, Ile, Lys, Leu, Met, Nle,  Arg, Ser, Thr, Val, Trp and Tyr
  MOD_RES (17)..(17): Xaa is an amino acid selected from a group consisting of Ala, Asp, Glu, Phe, Gly, Ile, Lys, Leu, Arg, Ser, Thr, Val, Trp and Tyr
  MOD_RES (18)..(18): Xaa is an amino acid selected from a group consisting of Cys and Asp
  MOD_RES (19)..(19): Xaa is an amino acid selected from a group consisting of Ala, Phe, Ile, Leu, Ser, Thr, Val, and Trp
  MOD_RES (20)..(20): Xaa is an amino acid selected from a group consisting of Phe and Trp
  MOD_RES (21)..(21): Xaa is an amino acid selected from a group consisting of Ile, Leu, and Val
  MOD_RES (22)..(22): Xaa is an amino acid selected from a group consisting of Ala, Asp, Glu, Phe, Gly, Ile, Lys, Leu, Pro, Arg, Ser, Thr, Val, and Trp
  MOD_RES (23)..(23): Xaa is an amino acid selected from a group consisting of Ala, Asp, Glu, Phe, Gly, Ile, Lys, Leu, Arg, Ser, Thr, Val, Trp and Tyr or is absent
XXXXWXXXXXXXXXXXXXXXXXX

SEQ ID NO: 3119 - protein, 23 aa, Artificial Sequence
  Synthetic peptide
  MOD_RES (1)..(1): Xaa is selected from any amino acid or is absent
  MOD_RES (2)..(2): Xaa is selected from any amino acid or is absent
  MOD_RES (3)..(3): Xaa is selected a group of amino acids consisting of Phe and Tyr
  MOD_RES (6)..(6): Xaa is selected a group of amino acids consisting of Phe and His
  DISULFID (7)..(18): Cys residues linked via disulfide bond
  MOD_RES (8)..(8): Xaa is selected from any amino acid
  MOD_RES (9)..(9): Xaa is selected a group of amino acids consisting of Met and Val
  MOD_RES (10)..(10): Xaa is selected from any amino acid
  MOD_RES (12)..(12): Xaa is selected from any amino acid
  MOD_RES (13)..(13): Xaa is selected from any amino acid
  MOD_RES (15)..(15): Xaa is selected a group of amino acids consisting of Ile and Thr
  MOD_RES (16)..(16): Xaa is selected from any amino acid
  MOD_RES (17)..(17): Xaa is selected a group of amino acids consisting of Ser and Thr
  MOD_RES (19)..(19): Xaa is selected a group of amino acids consisting of Ala and Val
  MOD_RES (22)..(22): Xaa is selected from any amino acid
  MOD_RES (23)..(23): Xaa is selected from any amino acid or is absent
XXXKWXCXXXDXXGXXXCXWVXX

SEQ ID NO: 3120 - protein, 21 aa, Artificial Sequence
  Synthetic peptide
  MOD_RES (1)..(1): Xaa is an amino acid selected from the group consisting of Ala, Cys, Asp, Phe, Gly, Ile, Lys, Leu, Met, Asn, Pro, Gln, Arg, Ser, Thr, Trp, Glu, His and Tyr or is absent
  MOD_RES (2)..(2): Xaa is an amino acid selected from the group consisting of Ala, Cys, Asp, Phe, His, Lys, Met, Asn, Pro, Arg, Ser, Thr, Trp, Tyr, Gly, Ile, and Leu or is absent
  MOD_RES (3)..(3): Xaa is an amino acid selected from the group consisting of Ala, Cys, Asp, Glu, Phe, Gly, His, Ile, Lys, Met, Asn, Pro, Arg, Ser, Thr, Trp, and Tyr
  MOD_RES (4)..(4): Xaa is an amino acid selected from the group consisting of Ala, Cys, Asp, Glu, Phe, Gly, His, Ile, Lys, Leu, Met, Asn, Gln, Arg, Ser, Thr, Val, Trp, Tyr and Pro
  MOD_RES (5)..(5): Xaa is an amino acid selected from the group consisting of Cys, Asp, Phe, Gly, His, Ile, Lys, Leu, Met, Asn, Pro, Arg, Ser, Thr, Val, Trp, and Tyr
  MOD_RES (6)..(6): Xaa is an amino acid selected from the group consisting of Ala, Trp, Cys, Lys, Pro, Arg, and His
  MOD_RES (7)..(7): Xaa is an amino acid selected from the group consisting of Gln, Ala, Cys, Phe, Gly, His, Ile, Lys, Leu, Asn, Arg, Thr, Trp and Tyr
  MOD_RES (8)..(8): Xaa is an amino acid selected from the group consisting of Ala, Cys, Phe, Gly, His, Lys, Leu, Met, Asn, Pro, Gln, Arg, Ser, Thr, Val, Trp, Tyr and Ile
  MOD_RES (9)..(9): Xaa is an amino acid selected from the group consisting of Ala, Cys, Phe, Gly, His, Ile, Leu, Met, Arg, Ser, Thr, Val, Trp, Tyr and Lys
  MOD_RES (10)..(10): Xaa is an amino acid selected from the group consisting of Ala, Cys, Phe, Gly, His, Ile, Lys,  Leu, Met, Asn, Pro, Gln, Arg, Ser, Thr, Val, Trp, and Tyr
  MOD_RES (11)..(11): Xaa is an amino acid selected from the group consisting of Ala, Gly, Ile, Lys, Leu, Met, Asn, Gln, Arg, Ser, Thr, Val, Trp, Tyr, Cys, Phe, and His
  MOD_RES (12)..(12): Xaa is an amino acid selected from the group consisting of Ala, Cys, His, Ile, Lys, Leu, and Arg
  MOD_RES (13)..(13): Xaa is an amino acid selected from the group consisting of Ala, Cys, Phe, Gly, His, Lys, Leu, Met, Arg, Ser, Val, Trp, Tyr, and Ile
  MOD_RES (14)..(14): Xaa is an amino acid selected from the group consisting of Ala, Cys, Phe, Gly, His, Ile, Leu, Met, Asn, Gln, Arg, Ser, Thr, Val, Trp, Tyr, and Lys
  MOD_RES (15)..(15): Xaa is an amino acid selected from the group consisting of Ala, Lys, and Arg
  MOD_RES (16)..(16): Xaa is an amino acid selected from the group consisting of Ala, Phe, Lys, and Arg
  MOD_RES (17)..(17): Xaa is an amino acid selected from the group consisting of Ala, Cys, Phe, Gly, Ile, Lys, Leu, Asn, Gln, Arg, Ser, Thr, Val, Trp, Tyr, His, and Met
  MOD_RES (18)..(18): Xaa is an amino acid selected from the group consisting of Ala, Cys, Phe, Ile, Lys, Leu, Met, Gln, Arg, Val, Trp, and Tyr
  MOD_RES (19)..(19): Xaa is an amino acid selected from the group consisting of Ala, Cys, Asp, Glu, Phe, Gly, His, Lys, Leu, Asn, Pro, Gln, Arg, Val, Trp, Tyr, and Ile
  MOD_RES (20)..(20): Xaa is an amino acid selected from the group consisting of Ala, Cys, Phe, Gly, His, Lys, Leu, Met, Asn, Gln, Arg, Val, Trp, Tyr, Ile, and Pro
  MOD_RES (21)..(21): Xaa is an amino acid selected from the group consisting of Ala, Cys, His, Ile, Lys, Leu, Met, Pro,  Arg, Thr, Val, Trp, Tyr, Phe, and Gly
XXXXXXXXXXXXXXXXXXXXX

SEQ ID NO: 3121 - protein, 21 aa, Artificial Sequence
  Synthetic peptide
  MOD_RES (1)..(1): Xaa is selected from any amino acid or is absent
  MOD_RES (2)..(2): Xaa is selected from any amino acid or is absent
  MOD_RES (3)..(3): Xaa is selected from any amino acid
  MOD_RES (4)..(4): Xaa is selected from any amino acid
  MOD_RES (5)..(5): Xaa is selected from any amino acid
  MOD_RES (6)..(6): Xaa is selected from any amino acid
  MOD_RES (7)..(7): Xaa is selected from any amino acid
  MOD_RES (8)..(8): Xaa is selected from any amino acid
  MOD_RES (9)..(9): Xaa is selected from any amino acid
  MOD_RES (10)..(10): Xaa is selected from any amino acid
  MOD_RES (11)..(11): Xaa is selected from any amino acid
  MOD_RES (13)..(13): Xaa is selected from any amino acid
  MOD_RES (14)..(14): Xaa is selected from any amino acid
  MOD_RES (15)..(15): Xaa is an amino acid selected from a group consisting of Lys and Arg
  MOD_RES (17)..(17): Xaa is selected from any amino acid
  MOD_RES (18)..(18): Xaa is selected from any amino acid
  MOD_RES (19)..(19): Xaa is selected from any amino acid
  MOD_RES (20)..(20): Xaa is selected from any amino acid
  MOD_RES (21)..(21): Xaa is selected from any amino acid
XXXXXXXXXXXHXXXRXXXXX

SEQ ID NO: 3122 - protein, 20 aa, Artificial Sequence
  Synthetic peptide
  MOD_RES (1)..(1): Xaa is an amino acid selected from the group consisting of Ala, Glu, and Pro or is absent
  MOD_RES (2)..(2): Xaa is an amino acid selected from the group consisting of Phe, Leu, Tyr, and Met
  MOD_RES (4)..(4): Xaa is an amino acid selected from the group consisting of Met, Gln, Arg, Ser, Thr, and Cys
  MOD_RES (5)..(5): Xaa is an amino acid selected from the group consisting of Aib, Lys, Pro, Arg, Glu, Ile, Tyr, Met, and Trp
  MOD_RES (6)..(6): Xaa is an amino acid selected from the group consisting of D-Ala, Aib, Asp, D-Asp, Gly, His, Lys, D-Lys, Asn, Nmg, D-Pro, Gln, Arg, Ala, Glu, Cys, and Met
  MOD_RES (7)..(7): Xaa is an amino acid selected from the group consisting of Ala, Cys, Asp, Gly, His, Lys, Asn, Gln, Arg, Ser, and Met
  MOD_RES (8)..(8): Xaa is an amino acid selected from the group consisting of Ile and Val
  MOD_RES (9)..(9): Xaa is an amino acid selected from the group consisting of Phe, His, and Tyr
  MOD_RES (11)..(11): Xaa is an amino acid selected from the group consisting of Ala, Asp, Glu, Lys, Met, Asn, Gln, Arg, Phe, His Pro, Ser, Val Trp
  MOD_RES (14)..(14): Xaa is an amino acid selected from the group consisting of Cys and Phe
  MOD_RES (15)..(15): Xaa is an amino acid selected from the group consisting of Ala, Cys, Asp, Glu, Lys, Leu, Met Asn, Gln, Arg, Thr, Val and Aib
  MOD_RES (18)..(18): Xaa is an amino acid selected from the group consisting of Ala, Aib, Cys, Cha, Dab, Dap, Eag, Eew, His, Har, Hci, Hle, Lys, Nle, Nva, Opa, Orn, Arg, Ile, Leu, Ser, and Met
  MOD_RES (19)..(19): Xaa is an amino acid selected from the group consisting of Ala, Leu, Asn, Met, and Arg
  MOD_RES (20)..(20): Xaa is an amino acid selected from the group consisting of Lys and Leu
XXQXXXXXXVXGYXXRLXKX

SEQ ID NO: 3123 - protein, 4 aa, Artificial Sequence
  Synthetic peptide
  MOD_RES (1)..(1): Xaa is Leu or Lys
  MOD_RES (2)..(2): Xaa is Gln or Lys
  MOD_RES (3)..(3): Xaa is Val or Lys
  MOD_RES (4)..(4): Xaa is Ala or Lys
XXXX

SEQ ID NO: 3124 - protein, 5 aa, Artificial Sequence
  Synthetic peptide
  MOD_RES (1)..(1): Xaa is Arg or Lys
  MOD_RES (2)..(2): Xaa is Leu or Lys
  MOD_RES (3)..(3): Xaa is Gln or Lys
  MOD_RES (4)..(4): Xaa is Val or Lys
  MOD_RES (5)..(5): Xaa is Ala or Lys
XXXXX

SEQ ID NO: 3125 - protein, 6 aa, Artificial Sequence
  Synthetic peptide
  MOD_RES (1)..(1): Xaa is Gly or Lys
  MOD_RES (2)..(2): Xaa is Arg or Lys
  MOD_RES (3)..(3): Xaa is Leu or Lys
  MOD_RES (4)..(4): Xaa is Gln or Lys
  MOD_RES (5)..(5): Xaa is Val or Lys
  MOD_RES (6)..(6): Xaa is Ala or Lys
XXXXXX

SEQ ID NO: 3126 - protein, 7 aa, Artificial Sequence
  Synthetic peptide
  MOD_RES (1)..(1): Xaa is Val or Lys
  MOD_RES (2)..(2): Xaa is Gly or Lys
  MOD_RES (3)..(3): Xaa is Arg or Lys
  MOD_RES (4)..(4): Xaa is Leu or Lys
  MOD_RES (5)..(5): Xaa is Gln or Lys
  MOD_RES (6)..(6): Xaa is Val or Lys
  MOD_RES (7)..(7): Xaa is Ala or Lys
XXXXXXX

SEQ ID NO: 3127 - protein, 8 aa, Artificial Sequence
  Synthetic peptide
  MOD_RES (1)..(1): Xaa is Gly or Lys
  MOD_RES (2)..(2): Xaa is Val or Lys
  MOD_RES (3)..(3): Xaa is Gly or Lys
  MOD_RES (4)..(4): Xaa is Arg or Lys
  MOD_RES (5)..(5): Xaa is Leu or Lys
  MOD_RES (6)..(6): Xaa is Gln or Lys
  MOD_RES (7)..(7): Xaa is Val or Lys
  MOD_RES (8)..(8): Xaa is Ala or Lys
XXXXXXXX

SEQ ID NO: 3128 - protein, 9 aa, Artificial Sequence
  Synthetic peptide
  MOD_RES (1)..(1): Xaa is Ser or Lys
  MOD_RES (2)..(2): Xaa is Gly or Lys
  MOD_RES (3)..(3): Xaa is Val or Lys
  MOD_RES (4)..(4): Xaa is Gly or Lys
  MOD_RES (5)..(5): Xaa is Arg or Lys
  MOD_RES (6)..(6): Xaa is Leu or Lys
  MOD_RES (7)..(7): Xaa is Gln or Lys
  MOD_RES (8)..(8): Xaa is Val or Lys
  MOD_RES (9)..(9): Xaa is Ala or Lys
XXXXXXXXX

SEQ ID NO: 3129 - protein, 10 aa, Artificial Sequence
  Synthetic peptide
  MOD_RES (2)..(2): Xaa is Ser or Lys
  MOD_RES (3)..(3): Xaa is Gly or Lys
  MOD_RES (4)..(4): Xaa is Val or Lys
  MOD_RES (5)..(5): Xaa is Gly or Lys
  MOD_RES (6)..(6): Xaa is Arg or Lys
  MOD_RES (7)..(7): Xaa is Leu or Lys
  MOD_RES (8)..(8): Xaa is Gln or Lys
  MOD_RES (9)..(9): Xaa is Val or Lys
  MOD_RES (10)..(10): Xaa is Ala or Lys
KXXXXXXXXX

SEQ ID NO: 3130 - protein, 11 aa, Artificial Sequence
  Synthetic peptide
  MOD_RES (3)..(3): Xaa is Ser or Lys
  MOD_RES (4)..(4): Xaa is Gly or Lys
  MOD_RES (5)..(5): Xaa is Val or Lys
  MOD_RES (6)..(6): Xaa is Gly or Lys
  MOD_RES (7)..(7): Xaa is Arg or Lys
  MOD_RES (8)..(8): Xaa is Leu or Lys
  MOD_RES (9)..(9): Xaa is Gln or Lys
  MOD_RES (10)..(10): Xaa is Val or Lys
  MOD_RES (11)..(11): Xaa is Ala or Lys
KKXXXXXXXXX

SEQ ID NO: 3131 - protein, 4 aa, Artificial Sequence
  Synthetic peptide
  MOD_RES (1)..(1): Xaa is Tyr or Lys
  MOD_RES (2)..(2): Xaa is Ser or Lys
XXKK

SEQ ID NO: 3132 - protein, 31 aa, Artificial Sequence; identical to SEQ ID NO: 3094
  Synthetic peptide
  MOD_RES (1)..(1): N-terminal acetylation
  MOD_RES (31)..(31): C-terminal amidation

SEQ ID NO: 3133 - protein, 31 aa, Artificial Sequence; identical to SEQ ID NO: 3095
  Synthetic peptide
  MOD_RES (1)..(1): N-terminal acetylation
  MOD_RES (1)..(1): N-terminal acetylation
  MOD_RES (31)..(31): C-terminal amidation

SEQ ID NO: 3134 - protein, 28 aa, Artificial Sequence
  Synthetic peptide
  MOD_RES (1)..(1): N-terminal acetylation
  MOD_RES (28)..(28): C-terminal amidation
SGGRKHKHFLRSNGKPSRALSSMHFWRW

SEQ ID NO: 3135 - protein, 25 aa, Artificial Sequence
  Synthetic peptide
  MOD_RES (1)..(1): N-terminal acetylation
  MOD_RES (25)..(25): C-terminal amidation
SGGRKHKHFLRSNGKPSRALSSMHF

SEQ ID NO: 3136 - protein, 22 aa, Artificial Sequence
  Synthetic peptide
  MOD_RES (1)..(1): N-terminal acetylation
  MOD_RES (22)..(22): C-terminal amidation
SGGRKHKHFLRSNGKPSRALSS

SEQ ID NO: 3137 - protein, 19 aa, Artificial Sequence
  Synthetic peptide
  MOD_RES (1)..(1): N-terminal acetylation
  MOD_RES (19)..(19): C-terminal amidation
SGGRKHKHFLRSNGKPSRA

SEQ ID NO: 3138 - protein, 28 aa, Artificial Sequence
  Synthetic peptide
RKHKHFLRSNGKPSRALSSMHFWRWSTS

SEQ ID NO: 3139 - protein, 25 aa, Artificial Sequence
  Synthetic peptide
  MOD_RES (1)..(1): N-terminal acetylation
  MOD_RES (25)..(25): C-terminal amidation
KHFLRSNGKPSRALSSMHFWRWSTS

SEQ ID NO: 3140 - protein, 22 aa, Artificial Sequence
  Synthetic peptide
  MOD_RES (1)..(1): N-terminal acetylation
  MOD_RES (22)..(22): C-terminal amidation
LRSNGKPSRALSSMHFWRWSTS

SEQ ID NO: 3141 - protein, 19 aa, Artificial Sequence
  Synthetic peptide
  MOD_RES (1)..(1): N-terminal acetylation
  MOD_RES (19)..(19): C-terminal amidation
NGKPSRALSSMHFWRWSTS

SEQ ID NO: 3142 - protein, 20 aa, Artificial Sequence
  Synthetic peptide
  MOD_RES (1)..(1): N-terminal acetylation
  MOD_RES (20)..(20): C-terminal amidation
SGGRKHKHFLRSNGKPSRAL

SEQ ID NO: 3143 - protein, 20 aa, Artificial Sequence
  Synthetic peptide
  MOD_RES (1)..(1): N-terminal acetylation
  MOD_RES (20)..(20): C-terminal amidation
RKHKHFLRSNGKPSRALSSM

SEQ ID NO: 3144 - protein, 20 aa, Artificial Sequence
  Synthetic peptide
  MOD_RES (1)..(1): N-terminal acetylation
  MOD_RES (20)..(20): C-terminal amidation
KHFLRSNGKPSRALSSMHFW

SEQ ID NO: 3145 - protein, 20 aa, Artificial Sequence
  Synthetic peptide
  MOD_RES (1)..(1): N-terminal acetylation
  MOD_RES (20)..(20): C-terminal amidation
SNGKPSRALSSMHFWRWSTS

---

What is claimed:

1. A peptide that binds TFPI, comprising the following structure of formula (I):

X1001-X1002-X1003-X1004-X1005-X1006-X1007-X1008-X1009-X1010-X1011-X1012-X1013-X1014-X1015-X1016-X1017-X1018-X1019-X1020 (I) (SEQ ID NO: 3116):

wherein X1001 is an amino acid selected from the group consisting of β-Homophenylalanine (Bhf), C, D, F, G, H, I, K, L, M, N, (S)—N-Methyl-phenylalanine (Nmf), Q, R, T, V, W and Y;

wherein X1002 is an amino acid selected from the group consisting of G and Q;

wherein X1003 is an amino acid selected from the group consisting of A, 2-Amino-isobutyric acid (Aib), β-Homoserine (Bhs), C, D, E, F, G, H, I, K, L, M, N, P, Q, R, S, T, V, W and Y;

wherein X1004 is an amino acid selected from the group consisting of A, Aib, β-Homolysine (Bhk), C, D, E, F, G, H, I, K, k, L, M, N, (S)—N-Methyl-lysine (Nmk), P, Q, R, S, T, V, W and Y;

wherein X1005 is an amino acid selected from the group consisting of a, A, Aib, β-Alanine (Bal), C, D, D-Aspartic Acid (d), E, F, G, H, K, k, L, M, N, N-Methyl-glycine (Nmg), D-Proline (p), Q, R, S, T, V, W and Y;

wherein X1006 is an amino acid selected from the group consisting of A, Aib, β-Homoasparagin (Btq), C, D, E, F, G, H, I, K, L, M, N, Q, R, S T, V, W and Y;

wherein X1007 is an amino acid selected from the group consisting of A, F, I, K, L, (S)—N-Methyl-valine (Nmv), P, Q, S, V, W and Y;

wherein X1008 is an amino acid selected from the group consisting of F, H, K, W and Y;

wherein X1009 is an amino acid selected from the group consisting of A, Aib, D-Phenylalanine (f), I, K, S, T and V;

wherein X1010 is an amino acid selected from the group consisting of A, Aib, C, D, E, F, G, H, I, K, L, M, N, Nmf, P, Q, R, S, T, V, W and Y;

wherein X1011 is an amino acid selected from the group consisting of Aib, C, K, G and Nmg;

wherein X1012 is Y;

wherein X1013 is an amino acid selected from the group consisting of A, Aib, C, E, F, G, H, K, L, M, Q, R, W and Y;

wherein X1014 is an amino acid selected from the group consisting of A, Aib, β-Homoglutamatic acid (Bhe), C, D, E, F, G, H, I, K, L, M, N, P, Q, R, S, T, V, W and Y;

wherein X1015 is an amino acid selected from the group consisting of (omega-methyl)-R, D, E, K and R;

wherein X1016 is L;

wherein X1017 is an amino acid selected from the group consisting of (omega-methyl)-R, A, Aib, β-Homoarginine (Bhr), C, (S)-Cyclohexylalanine (Cha), (S)-Citrullin (Cit), D, (S)-2,4-Diaminobutyric acid (Dab), (S)-Diaminopropionic acid (Dap), E, (S)-2-Propargylglycine (Eag), (S)—N(omega)-nitro-arginine (Eew), F, G, H, (S)-Homo-arginine (Har), (S)-Homo-citrulline (Hci), (S)-2-Amino-5-methyl-hexanoic acid (Hle), I, K, L, M, N, (S)-Norleucine (Nle), (S)-2-Amino-pentanoic acid (Nva), (S)-2-Pyridyl-alanine (Opa), (S)-Ornithine (Orn), Q, R, S, T, V, W and Y;

wherein X1018 is an amino acid selected from the group consisting of A, Bal, C, D, E, F, G, H, I, K, L, M, N, Q, R, S, T, V, W and Y;

wherein X1019 is an amino acid selected from the group consisting of Bhk, K, R and V; and wherein X1020 is either present or absent, whereby in case X1020 is present it is an amino acid selected from the group consisting of Aib, β-Homoleucine (Bhl), C, F, G, H, I, K, L, (S)—N-Methyl-leucine (Nml), Q, R, S, T, V, W and Y.

2. A peptide that binds TFPI, comprising the following structure of formula (III):

X1001-Q-X1003-X1004-X1005-X1006-I/V-X1008-V-X1010-G-Y-C/F-X1014-R-L-X1017-X1018-K-K/L (III) (SEQ ID NO: 3117)

wherein X1001, X1003, X1004, X1005, X1006, X1008, X1010, X1014, X1017 and X1018 are each independently selected from any amino acid.

3. The peptide of claim 1, the peptide consisting of the amino acid sequence selected from the group consisting of SEQ ID NOs: 16-123, 125-127, 129-178, 183-188, 190-252, 256-270, 272-284, 286-405, 407-422, 424-428, 430-434, 436-452, 455-458, 461, 468, 471, 472, 474, 475, 478-480, 482-484, 486-488, 490, 491, 493-498, 500-502, 505-507, 509, 511-519, 523, 524, 527, 530, 532, 533, 536, 538-540, 542, 545, 548-550, 553-559, 561, 563-565, 568-572, 576, 577, 579-582, 584-628, 630, 632, 633, 635-648, 650-658, 660-671, 690-693, 698, 700-709, 720, 724, 725, 731, 736-740, 747, 749, 765, 767-769, 774, 783, 785-788, 791, 795, 807, 811, 817, 818, 823, 829, 835, 851, 858, 872-874, 876, 893, 926, 938, 944, 952, 953, and 972, 973, and 975-978.

4. A method for treating a blood coagulation disorder in a subject, the method comprising administering to the subject a peptide that inhibits TFPI activity, wherein the peptide is administered in an amount sufficient to treat the blood coagulation disorder in the subject.

5. The method according to claim 4, wherein the peptide is a peptide as defined in claim 1.

* * * * *